United States Patent
Lin et al.

(10) Patent No.: US 12,286,654 B2
(45) Date of Patent: Apr. 29, 2025

(54) BASE EDITING ENZYMES

(71) Applicant: Metagenomi, Inc., Emeryville, CA (US)

(72) Inventors: Jyun-Liang Lin, Emeryville, CA (US); Alan Brooks, Emeryville, CA (US); Cristina Butterfield, Emeryville, CA (US); Christopher Brown, Emeryville, CA (US); Cindy Castelle, Emeryville, CA (US); Brian C. Thomas, Emeryville, CA (US)

(73) Assignee: Metagenomi, Inc., Emeryville, CA (US)

( * ) Notice: Subject to any disclaimer, the term of this patent is extended or adjusted under 35 U.S.C. 154(b) by 0 days.

(21) Appl. No.: 17/841,082

(22) Filed: Jun. 15, 2022

(65) Prior Publication Data
US 2022/0364067 A1    Nov. 17, 2022

Related U.S. Application Data

(63) Continuation of application No. PCT/US2021/049962, filed on Sep. 10, 2021.

(60) Provisional application No. 63/222,351, filed on Jul. 15, 2021, provisional application No. 63/077,057, filed on Sep. 11, 2020.

(51) Int. Cl.
| | |
|---|---|
| *C12N 9/22* | (2006.01) |
| *C12N 9/78* | (2006.01) |
| *C12N 15/11* | (2006.01) |
| *C12N 15/113* | (2010.01) |
| *C12N 15/85* | (2006.01) |
| *C12N 15/90* | (2006.01) |

(52) U.S. Cl.
CPC ............. *C12N 9/22* (2013.01); *C12N 9/78* (2013.01); *C12N 15/11* (2013.01); *C12N 15/111* (2013.01); *C12N 15/1137* (2013.01); *C12N 15/85* (2013.01); *C12N 15/907* (2013.01); *C12Y 302/02027* (2013.01); *C12Y 305/04004* (2013.01); *C12N 2310/20* (2017.05); *C12N 2800/107* (2013.01); *C12N 2800/80* (2013.01)

(58) Field of Classification Search
CPC .......... C12N 9/22; C12N 15/11; C12N 15/85; C12N 15/907; C12N 2310/20; C12N 2800/107; C12N 2800/80; C12N 9/2497; C12N 15/102; C12N 9/78; C12N 15/70; C12N 15/90; C12N 15/113; C07K 2319/00; C12Y 302/02027; C12Y 305/04004
See application file for complete search history.

(56) References Cited

U.S. PATENT DOCUMENTS

| | | |
|---|---|---|
| 2018/0170984 A1 | 6/2018 | Harris et al. |
| 2018/0258418 A1 | 9/2018 | Kim |
| 2018/0371498 A1 | 12/2018 | Gill et al. |
| 2022/0364067 A1 | 11/2022 | Lin et al. |
| 2024/0309404 A1 | 9/2024 | Thomas et al. |

FOREIGN PATENT DOCUMENTS

| | | |
|---|---|---|
| EP | 3617311 A1 | 3/2020 |
| WO | WO-2018176009 A1 | 9/2018 |
| WO | WO-2020168234 A1 | 8/2020 |
| WO | WO-2020168291 A1 | 8/2020 |
| WO | WO-2021097118 A1 | 5/2021 |
| WO | WO-2022056301 A1 | 3/2022 |
| WO | WO-2022056324 A1 | 3/2022 |
| WO | WO-2023081855 A1 | 5/2023 |

OTHER PUBLICATIONS

Witkowski et al., Biochemistry 38:11643-11650, 1999.*
Tang et al., Phil Trans R Soc B 368:20120318, 1-10, 2013.*
Seffernick et al., J. Bacteriol. 183(8):2405-2410, 2001.*
Singh et al., Current Protein and Peptide Science 19(1):5-15, 2018.*
Sadowski et al., Current Opinion in Structural Biology 19:357-362, 2009.*
Liu et al.: Application of different types of CRISPR/Cas-based systems in bacteria. Microb Cell Fact. 19(1):172:1-14 doi:10.1186/s12934-020-01431-z (2020).
Baker et al.: Did Dendritic Cell Activation, Induced by Adenovirus-Antibody Complexes, Play a Role in the Death of Jesse Gelsinger? Mol Ther. 28(3):704-706 doi:10.1016/j.ymthe.2020.02.010 (2020).
Brinkman et al.: Easy quantitative assessment of genome editing by sequence trace decomposition. Nucleic Acids Research 42(22):e168 , pp. 1-8 doi: 10.1093/nar/gku936 (2014).
Carreras et al.: In vivo genome and base editing of a human PCSK9 knock-in hypercholesterolemic mouse model. BMC Biol. 17(1):4 doi:10.1186/s12915-018-0624-2 [1- 14](2019).
Deyle et al.: Adeno-associated virus vector integration. Curr Opin Mol Ther. 11(4):442-447 (2009).
Finn et al.: A Single Administration of CRISPR/Cas9 Lipid Nanoparticles Achieves Robust and Persistent In Vivo Genome Editing. Cell Rep. 22(9):2227-2235 doi:10.1016/j.celrep.2018.02.014 (2018).
Herbert et al.: Increased secretion of lipoproteins in transgenic mice expressing human D374Y PCSK9 under physiological genetic control. Arterioscler Thromb Vasc Biol. 30(7):1333-1339 doi:10.1161/ATVBAHA.110.204040 (2010).
Jinek et al. A programmable dual-RNA-guided DNA endonuclease in adaptive bacterial immunity. Science 337(6096):816-821 (2012).
Kim et al.: Genome-wide target specificities of CRISPR RNA-guided programmable deaminases. Nat Biotechnol. 35(5):475-480 (2017).

(Continued)

*Primary Examiner* — Delia M Ramirez
(74) *Attorney, Agent, or Firm* — Wilson Sonsini Goodrich & Rosati

(57) ABSTRACT

The present disclosure provides for endonuclease enzymes having distinguishing domain features, as well as methods of using such enzymes or variants thereof.

15 Claims, 25 Drawing Sheets
Specification includes a Sequence Listing.

(56) References Cited

OTHER PUBLICATIONS

Kim et al., Highly efficient RNA-guided bases editing in mouse embryos. Nat Biotech 35: 435-437 (2017).
Levy et al.: Cytosine and adenine base editing of the brain, liver, retina, heart and skeletal muscle of mice via adeno-associated viruses. Nat Biomed Eng. 4(1):97-110 doi:10.1038/s41551-019-0501-5 (2020).
Mali et al. RNA-guided human genome engineering via Cas9. Science 339(6121):823-826 (2013).
Mishra et al.: Base editing in crops: current advances, limitations and future implications. Plant Biotechnol J. 18(1):20-31 doi:10.1111/pbi.13225 (2020).
Moon et al.: Recent advances in the CRISPR genome editing tool set. Exp Mol Med. 51(11):1-11 (2019).
NCBI GenBank Accession No. EDV12729.1: tRNA-specific adenosine deaminase 2 [*Saccharomyces cerevisiae* RM11-1a], Published Jul. 26, 2016.
NCBI GenBank Accession No. WP_094758060.1: HNH endonuclease [*Rothia* sp. *Olga*], Published Jul. 27, 2021.
PCT/US2021/049931 International Search Report and Written Opinion dated Jan. 12, 2022.
PCT/US2021/049962 International Search Report and Written Opinion dated Feb. 25, 2022.
Ribeiro, et al. Protein Engineering Strategies to Expand CRISPR-Cas9 Applications. International Journal of Genomics, vol. 2018, Aug. 2, 2018, pp. 1-12.
Sabatine: PCSK9 inhibitors: clinical evidence and implementation. Nature Reviews Cardiology 16(3):155-165 doi:10.1038/s41569-018-0107-8 (2019).
Yin et al.: Therapeutic genome editing by combined viral and non-viral delivery of CRISPR system components in vivo. Nat Biotechnol. 34(3):328-333 doi: 10.1038/nbt.3471 (2016).
Young et al.: The promise and potential hazards of adenovirus gene therapy. Gut 48(5):733-736 doi:10.1136/gut.48.5.733 (2001).
Yuan Zong et al.: "Precise base editing in rice, wheat and maize with aCas9-cytidine deaminase fusion", Nature Biotechnology, vol. 35, No. 5, Feb. 27, 2017, pp. 438-440.
Zhang et al.: In Vivo Gene Delivery by Nonviral Vectors: Overcoming Hurdles? Molecular Therapy 20(7):1298-1304 doi:10.1038/mt.2012.79 (2012).
Gaudelli et al.: Directed evolution of adenine base editors with increased activity and therapeutic application. Nat Biotechnol. 38(7):892-900 doi:10.1038/s41587-020-0491-6 (2020).
Gaudelli, et al. Programmable base editing of A•T to G•C in genomic DNA without DNA cleavage. Nature. Nov. 23, 2017; 551(7681): 464-471. Published online Oct. 25, 2017. doi: 10.1038/nature24644.
Jeong et al.: Adenine base editor engineering reduces editing of bystander cytosines. Nat Biotechnol. 39(11):1426-1433 doi:10.1038/s41587-021-00943-2 (2021).
Kohli et al.: A portable hot spot recognition loop transfers sequence preferences from APOBEC family members to activation-induced cytidine deaminase. J Biol Chem. 284(34):22898-22904 doi:10.1074/jbc.M109.025536 (2009).
Mok, et al. A bacterial cytidine deaminase toxin enables CRISPR-free mitochondrial base editing. Nature. Jul. 2020;583(7817):631-637. doi: 10.1038/s41586-020-2477-4. Epub Jul. 8, 2020.
Richter et al.: Phage-assisted evolution of an adenine base editor with improved Cas domain compatibility and activity. Nat Biotechnol. 38(7):883-891 doi:10.1038/s41587-020-0453-z (2020).
Shi et al. Structural Basis for Targeted DNA Cytosine Deamination and Mutagenesis by APOBEC3A and APOBEC3B. Nature Structural & Molecular Biology 24(2):131-139 (2017).
UniProt Accession No. A0A2K5RDN7:CMP/dCMP-type deaminase domain-containing protein (2018).
Wolfe et al.: The structure of APOBEC1 and insights into its RNA and DNA substrate selectivity. NAR Cancer. 2(4):zcaa027:1-15 doi:10.1093/narcan/zcaa027 (2020).
Workman et al.: A natural single-guide RNA repurposes Cas9 to autoregulate CRISPR-Cas expression. Cell. 184(3):675-688.e19:1-34 doi:10.1016/j.cell.2020.12.017 (2021).
Yu et al.: Cytosine base editors with minimized unguided DNA and RNA off-target events and high on-target activity. Nat Commun. 11(1):2052:1-10 doi:10.1038/s41467-020-15887-5 (2020).
Co-pending U.S. Appl. No. 18/180,009, inventors Lin; Jyun-Liang et al., filed Mar. 7, 2023.
Co-pending U.S. Appl. No. 18/180,633, inventors Lin; Jyun-Liang et al., filed Mar. 8, 2023.
Co-pending U.S. Appl. No. 18/326,440, inventors Thomas; Brian C et al., filed May 31, 2023.
PCT/US2022/079345 International Search Report and Written Opinion dated Mar. 2, 2023.
UniProt accession No. A0A8S5MVN9, pp. 1-2 (Oct. 12, 2022).
UniProt accession No. A0A8S5N1WO, pp. 1-2 (Oct. 12, 2022).
UniProt accession No. A0A8S5UMQ3, pp. 1-2 (Oct. 12, 2022).
Co-pending U.S. Appl. No. 18/653,454, inventors Brian; C. Thomas et al., filed May 2, 2024.
Feng, Y et al., FAM72A antagonizes UNG2 to promote mutagenic repair during antibody maturation, Nature, Dec. 2021, vol. 600, No. 7888, pp. 324-328.
Jinek, Martin et al. A Programmable Dual-RNA-guided DNA Endonuclease in Adaptive Bacterial Immunity. Science vol. 337,6096: pp. 816-821 (2012).
Kohli, Rahul M et al. A Portable Hot Spot Recognition Loop Transfers Sequence Preferences From APOBEC Family Members to Activation-induced Cytidine Deaminase. The Journal of Biological Chemistry vol. 284,34: pp. 22898-22904 (2009).
Rathore, A.. et al., The Local Dinucleotide Preference of APOBEC3G Can Be Altered from 5'-CC to 5'-TC by a Single Amino Acid Substitution, J. Mol Biol., 2013, vol. 425, pp. 4442-4454.
Rogier, M. et al., Fam72a enforces error-prone DNA repair during antibody diversification, Nature, 2021, vol. 600, pp. 329-333.
Yu, Y et al. Cytosine Base Editors with Minimized Unguided DNA and RNA off-Target Events and High on-Target Activity. Nature Communications vol. 2052: pp. 1-10 (2020).
Zhang, Yuan et al. In Vivo Gene Delivery by Nonviral Vectors: Overcoming Hurdles?. Molecular Therapy vol. 20,7: pp. 1298-1304 (2012).
Humphrey W et al. VMD: Visual Molecular Dynamics. Journal of Molecular Graphics vol. 14, 1: pp. 33-38 (1996).

* cited by examiner

FIG. 6A

| Candidate | sgRNA sequence | PAM | 1 | 2 | 3 | 4 | 5 | 6 | 7 | 8 | 9 | 10 | 11 | 12 | 13 | 14 | 15 | 16 | 17 | 18 | 19 | 20 | 21 | 22 |
|---|---|---|---|---|---|---|---|---|---|---|---|---|---|---|---|---|---|---|---|---|---|---|---|---|
| MGC1-4 | CGCCGTTTCATCTGTGGTGCAA | CCGG | | | | | | | | | | | | | | | | | | | | | | A |
| MGC1-6 | GCAGGACAGTGTTGCCGTC | TGAA | | | | | | | | | | | | | | | | | | | | | T | G |
| MGC1-8 | TCAGCCGGCTGTACTGGAGGC | TGAA | | | | | | | | | | | | | | | | | | | | | G | |
| MGC3-5 | CCTTCCCAACAGTTGCCACC | CTAAT | | | | | | | | | | | | | | | | | | | | | T | G |
| MGC3-7 | CTGTCGTCGTCCCCAAACTG | GCAGAT | | | | | | | | | | | | | | | | | | | | | A | A |
| MGC3-8 | CTACGGCAGTTATCGGAAGA | TCAGAT | | | | | | | | | | | | | | | | | | | | | A | G |
| MGC4-5 | GTGACGGCAGTCTGGACCG | CGCGAC | | | | | | | | | | | | | | | | | | | | | T | T |
| MGC7-1 | ATGATTCACCGGCAGATGCA | CTCGGAT | | | | | | | | | | | | | | | | | | | | | A | T |
| MGC14-1 | TTACGGCGTTGCCTGGTT | CGGTGAC | | | | | | | | | | | | | | | | | | | | | A | G |
| MGC15-1 | CGAATGGCGTTCAACTGCACG | COGGGTC | | | | | | | | | | | | | | | | | | | | | A | C |
| MGC18-1 | TCCCTCAACAACGTGACTAT | CCATTAC | | | | | | | | | | | | | | | | | | | | | G | A |
| BE3 | | | | | | | | | | | | | | | | | | | | | | | | |

| sgRNA | TadA variant | Tested/edited |
|---|---|---|
| - | EcTadA | 1/0 |
| + | EcTadA | 12/0 |
| | MG68-1 | 4/0 |
| | MG68-2 | 8/0 |
| | MG68-3 | 8/2 |
| | MG68-4 | 11/3 |
| | MG68-5 | 8/0 |
| | MG68-6 | 5/0 |
| | MG68-7 | 6/0 |
| | MG68-8 | 1/1 |

FIG. 16B

| | 24 W | 83 V | 85 L | 107 A | 109 D | 112 T | 124 H | 143 A | 147 S | 148 D | 154 R | 158 K |
|---|---|---|---|---|---|---|---|---|---|---|---|---|
| MG68-4 | W | V | L | A | D | T | H | A | S | D | R | K |
| MG68-4_V1 | | | | | N | | | | | | | |
| MG68-4_V2 | | | | V | N | | | | | | | |
| MG68-4_V3 | | | | | N | | | | | Y | | |
| MG68-4_V4 | | | F | | N | | | N | | | | |
| MG68-4_V5 | | | | | N | | | | C | | | |
| MG68-4_V6 | | | | | N | | | | | | | |
| MG68-4_V7 | | | | | N | | Y | | | | | |
| MG68-4_V8 | | | | | N | | | | | | | N |
| MG68-4_V9 | R | S | | | N | | | | | | | |
| MG68-4_V10 | | | | | N | | | | | | | |
| MG68-4_V11 | | | | | N | R | | | | | | |
| MG68-4_V12 | | | | | N | | | | | R | | |
| MG68-4_V13 | | | | | N | | | | | | P | |
| MG68-4_V14 | | | F | V | N | | Y | | C | Y | | |
| MG68-4_V15 | | | F | V | N | | Y | | C | Y | | |
| MG68-4_V16 | | | F | V | N | | Y | | C | Y | | |
| MG68-4_V17 | | | F | V | N | | Y | | C | Y | | N |
| MG68-4_V18 | | | F | V | N | | Y | N | C | Y | | N |
| MG68-4_V19 | | | F | V | N | | Y | N | C | Y | P | N |
| MG68-4_V20 | R | | F | V | N | | Y | N | C | Y | P | N |
| MG68-4_V21 | R | S | F | V | N | | Y | N | C | Y | P | N |
| MG68-4_V22 | R | S | F | V | N | | Y | | C | Y | P | N |
| MG68-4_V23 | R | S | F | V | N | | Y | | C | Y | P | N |
| MG68-4_V24 | R | | F | V | N | | Y | N | C | Y | P | N |
| MG68-4_V25 | R | | F | V | N | | H | N | C | R | P | N |
| MG68-4_V26 | R | S | F | V | N | R | H | N | C | R | P | N |
| MG68-4_V27 | R | S | F | V | N | R | H | N | C | R | P | N |
| MG68-4_V28 | R | S | F | V | N | | H | N | C | Q | P | N |

*FIG. 19*

BASE EDITING ENZYMES

CROSS-REFERENCE

This application is a continuation application of International Application No. PCT/US2021/049962 filed Sep. 10, 2021, entitled "BASE EDITING ENZYMES", which claims the benefit of U.S. Provisional Application No. 63/077,057, filed on Sep. 11, 2020, entitled "BASE EDITING ENZYMES"; and U.S. Provisional Application No. 63/222,351, filed on Jul. 15, 2021, entitled "BASE EDITING ENZYMES", each of which is incorporated by reference in its entirety herein.

BACKGROUND

Cas enzymes along with their associated Clustered Regularly Interspaced Short Palindromic Repeats (CRISPR) guide ribonucleic acids (RNAs) appear to be a pervasive (~45% of bacteria, ~84% of archaea) component of prokaryotic immune systems, serving to protect such microorganisms against non-self nucleic acids, such as infectious viruses and plasmids by CRISPR-RNA guided nucleic acid cleavage. While the deoxyribonucleic acid (DNA) elements encoding CRISPR RNA elements may be relatively conserved in structure and length, their CRISPR-associated (Cas) proteins are highly diverse, containing a wide variety of nucleic acid-interacting domains. While CRISPR DNA elements have been observed as early as 1987, the programmable endonuclease cleavage ability of CRISPR/Cas complexes has only been recognized relatively recently, leading to the use of recombinant CRISPR/Cas systems in diverse DNA manipulation and gene editing applications.

SEQUENCE LISTING

The instant application contains a Sequence Listing which has been submitted electronically in ASCII format and is hereby incorporated by reference in its entirety. Said ASCII copy, created on Mar. 14, 2023, is named 55921-715_301_SL.txt and is 746,648 bytes in size.

SUMMARY

In some aspects, the present disclosure provides for an engineered nucleic acid editing system, comprising: an endonuclease comprising a RuvC domain and an HNH domain, wherein said endonuclease is derived from an uncultivated microorganism, wherein said endonuclease is a class 2, type II Cas endonuclease, wherein said endonuclease is configured to be deficient in nuclease activity; a base editor coupled to said endonuclease; and an engineered guide ribonucleic acid structure configured to form a complex with said endonuclease comprising: a guide ribonucleic acid sequence configured to hybridize to a target deoxyribonucleic acid sequence; and a ribonucleic acid sequence configured to bind to said endonuclease. In some embodiments, said RuvC domain lacks nuclease activity. In some embodiments, said class 2, type II Cas endonuclease comprises a nickase mutation. In some embodiments, said class 2, type II Cas endonuclease comprises the aspartate to alanine mutation at residue 9 relative to SEQ ID NO: 70, residue 13 relative to SEQ ID NOs: 71, 72, or 74, residue 12 relative to SEQ ID NO: 73, residue 17 relative to SEQ ID NO: 75, residue 23 relative to SEQ ID NO: 76, or residue 10 relative to SEQ ID NO: 597 when optimally aligned. In some embodiments, said endonuclease comprises an aspartate to alanine mutation at residue 9 relative to SEQ ID NO: 70, residue 13 relative to SEQ ID NO: 72, or residue 17 relative to SEQ ID NO: 75 when optimally aligned. In some embodiments, said endonuclease comprises a sequence with at least 95% sequence identity to any one of SEQ ID NOs:70-78 or 597 or a variant thereof. In some aspects, the present disclosure provides for an engineered nucleic acid editing system comprising: an endonuclease having at least 95% sequence identity to any one of SEQ ID NOs:70-78 or 597 or a variant thereof, a base editor coupled to said endonuclease; and an engineered guide ribonucleic acid structure configured to form a complex with said endonuclease comprising: a guide ribonucleic acid sequence configured to hybridize to a target deoxyribonucleic acid sequence; and a ribonucleic acid sequence configured to bind to said endonuclease. In some aspects, the present disclosure provides for an engineered nucleic acid editing system comprising: an endonuclease configured to bind to a protospacer adjacent motif (PAM) sequence comprising any one of SEQ ID NOs: 360-368 or 598 or a variant thereof, wherein said endonuclease is a class 2, type II Cas endonuclease, and wherein said endonuclease is configured to be deficient in nuclease activity; a base editor coupled to said endonuclease; and an engineered guide ribonucleic acid structure configured to form a complex with said endonuclease comprising: a guide ribonucleic acid sequence configured to hybridize to a target deoxyribonucleic acid sequence; and a ribonucleic acid sequence configured to bind to said endonuclease. In some embodiments, said endonuclease comprises a nickase mutation. In some embodiments, said endonuclease is configured to cleave one strand of a double-stranded target deoxyribonucleic acid. In some embodiments, said class 2, type II Cas endonuclease comprises an aspartate to alanine mutation at residue 9 relative to SEQ ID NO: 70, residue 13 relative to SEQ ID NOs: 71, 72, or 74, residue 12 relative to SEQ ID NO: 73, residue 17 relative to SEQ ID NO: 75, residue 23 relative to SEQ ID NO: 76, or residue 10 relative to SEQ ID NO: 597 when optimally aligned. In some embodiments, said base editor comprises a sequence having at least 70%, 80%, 90% or 95% identity to any one of SEQ ID NOs: 1-51, 57-66, 385-443, 444-475, or 594-595 or a variant thereof. In some embodiments, said base editor comprises a sequence having at least 70%, 80%, 90% or 95% identity to any one of SEQ ID NOs: 50-51 or 385-390. In some embodiments, said RuvC domain lacks nuclease activity. In some embodiments, said endonuclease is derived from an uncultivated microorganism. In some embodiments, said endonuclease has less than 80% identity to a Cas9 endonuclease. In some embodiments, said endonuclease further comprises an HNH domain. In some embodiments, said engineered guide ribonucleic acid sequence comprises a sequence with at least 80% sequence identity to non-degenerate nucleotides of any one of SEQ ID NOs: 88-96 or 488-489 or a variant thereof. In some aspects, the present disclosure provides for an engineered nucleic acid editing system comprising, an engineered guide ribonucleic acid structure comprising: a guide ribonucleic acid sequence configured to hybridize to a target deoxyribonucleic acid sequence; and a ribonucleic acid sequence configured to bind to an endonuclease, wherein said engineered ribonucleic acid sequence comprises a sequence with at least 80% sequence identity to non-degenerate nucleotides of any one of SEQ ID NOs: 88-96 or 488-489 or a variant thereof; a class 2, type II Cas endonuclease configured to bind to said engineered guide ribonucleic acid; and a base editor coupled to said endonuclease. In some embodiments, said base editor comprises a sequence having at least 70%, 80%, 90% or 95% identity to any one of SEQ ID NOs: 50-51 or 385-390. In some embodiments, said endonuclease is configured to bind to a protospacer adjacent motif (PAM) sequence selected from the group consisting of SEQ ID NOs: 360-368 or 598. In some embodiments, said base editor comprises a sequence with at least 70%, 80%, 90% or 95% identity to any one of SEQ ID NOs: 1-51, 57-66, 385-443, 444-475, or 594-595 or a variant thereof. In some embodiments, said base editor is an adenosine deaminase. In some embodiments, said adenosine deaminase comprises a sequence with at least 70%, 80%, 90% or 95% identity to any one of SEQ ID NOs: 50-51, 57, 385-443, 448-475, or 595 or a variant thereof. In some embodiments, said base editor is a cytosine deaminase. In some embodiments, said cytosine deaminase comprises a sequence with at least 70%, 80%, 90% or 95% identity to any one of SEQ ID NOs: 1-49, 444-447, 594, or 58-66 or a variant thereof. In some embodiments, the system further comprises a uracil DNA glycosylase inhibitor coupled to said endonuclease or said base editor. In some embodiments, said uracil DNA glycosylase inhibitor comprises a sequence with at least 70%, 80%, 90% or 95% identity to any one of SEQ ID NOs: 52-56 or SEQ ID NO: 67. In some embodiments, said engineered guide ribonucleic acid structure comprises at least two ribonucleic acid polynucleotides. In some embodiments, said engineered guide ribonucleic acid structure comprises one ribonucleic acid polynucleotide comprising said guide ribonucleic acid sequence and said tracr ribonucleic acid sequence. In some embodiments, said guide ribonucleic acid sequence is complementary to a prokaryotic, bacterial, archaeal, eukaryotic, fungal, plant, mammalian, or human genomic sequence. In some embodiments, said guide ribonucleic acid sequence is 15-24 nucleotides in length. In some embodiments, said endonuclease comprises one or more nuclear localization sequences (NLSs) proximal to an N- or C-terminus of said endonuclease. In some embodiments, said NLS comprises a sequence with at least 90% identity to a selected from SEQ ID NOs: 369-384 or a variant thereof. In some embodiments, said endonuclease is covalently coupled directly to said base editor or covalently coupled to said base editor through a linker. In some embodiments, said endonuclease comprises an aspartate to alanine mutation at residue 9 relative to SEQ ID NO: 70, residue 13 relative to SEQ ID NOs: 71, 72, or 74, residue 12 relative to SEQ ID NO: 73 or 78, residue 17 relative to SEQ ID NO: 75, residue 23 relative to SEQ ID NO: 76, residue 8 relative to SEQ ID NO: 77, or residue 10 relative to SEQ ID NO: 597 when optimally aligned. In some embodiments, said endonuclease comprises an aspartate to alanine mutation at residue 9 relative to SEQ ID NO: 70, residue 13 relative to SEQ ID NO: 72, or residue 17 relative to SEQ ID NO: 75 when optimally aligned. In some embodiments, a polypeptide comprises said endonuclease and said base editor. In some embodiments, said endonuclease is configured to cleave one strand of a double-stranded target deoxyribonucleic acid. In some embodiments, said system further comprises a source of $Mg^{2+}$. In some embodiments: (a) said endonuclease comprises a sequence at least 70%, at least 80%, or at least 90% identical to any one of SEQ ID NOs: 70, 71, 73, 74, 76, 78, 77, or 78 or a variant thereof; (b) said guide RNA structure comprises a sequence at least 70%, at least 80%, or at least 90% identical to non-degenerate nucleotides of any one of SEQ ID NOs: 88, 89, 91, 92, 94, 96, 95, or 488; (c) said endonuclease is configured to bind to a PAM comprising any one of SEQ ID NOs: 360, 361, 363, 365, 367, or 368; or (d) said base editor comprises a sequence at least 70%, at least 80%, or at least 90% identical to SEQ ID NOs: 58 or 595 or a variant thereof. In some embodiments: (a) said endonuclease comprises a sequence at least 70%, at least 80%, or at least 90% identical to any one of SEQ ID NOs: 70, 71, or 78 or a variant thereof, (b) said guide RNA structure comprises a sequence at least 70%, at least 80%, or at least 90% identical to non-degenerate nucleotides of at least one of SEQ ID NOs: 88, 89, or 96; (c) said endonuclease is configured to bind to a PAM comprising any one of SEQ ID NOs: 360, 362, or 368; or (d) said base editor comprises a sequence at least 70%, at least 80%, or at least 90% identical to SEQ ID NO: 594 or a variant thereof. In some embodiments, said sequence identity is determined by a BLASTP, CLUSTALW, MUSCLE, MAFFT, or Smith-Waterman homology search algorithm. In some embodiments, said sequence identity is determined by said BLASTP homology search algorithm using parameters of a wordlength (W) of 3, an expectation (E) of 10, and a BLOSUM62 scoring matrix setting gap costs at existence of 11, extension of 1, and using a conditional compositional score matrix adjustment. In some embodiments, said endonuclease is configured to be catalytically dead. In some embodiments, said endonuclease is configured to cleave one strand of a double-stranded target deoxyribonucleic acid.

In some aspects, the present disclosure provides for a nucleic acid comprising an engineered nucleic acid sequence optimized for expression in an organism, wherein said nucleic acid encodes a class 2, type II Cas endonuclease coupled to a base editor, and wherein said endonuclease is derived from an uncultivated microorganism.

In some aspects, the present disclosure provides for a nucleic acid comprising an engineered nucleic acid sequence optimized for expression in an organism, wherein said nucleic acid encodes an endonuclease having at least 70% sequence identity to any one of SEQ ID NOs: 70-78 coupled to a base editor. In some embodiments, said endonuclease comprises a sequence encoding one or more nuclear localization sequences (NLSs) proximal to an N- or C-terminus of said endonuclease. In some embodiments, said NLS comprises a sequence with at least 90% identity to a selected from SEQ ID NOs: 369-384 or a variant thereof. In some embodiments, said organism is prokaryotic, bacterial, eukaryotic, fungal, plant, mammalian, rodent, or human.

In some aspects, the present disclosure provides for a vector comprising a nucleic acid sequence encoding a class 2, type II Cas endonuclease coupled to a base editor, wherein said endonuclease is derived from an uncultivated microorganism.

In some aspects, the present disclosure provides for a vector comprising the nucleic acid of any of the aspects or embodiments described herein. In some embodiments, the vector further comprises a nucleic acid encoding an engineered guide ribonucleic acid structure configured to form a complex with said endonuclease comprising: a guide ribonucleic acid sequence configured to hybridize to a target deoxyribonucleic acid sequence; and a ribonucleic acid sequence configured to binding to said endonuclease. In some embodiments, the vector is a plasmid, a minicircle, a CELiD, an adeno-associated virus (AAV) derived virion, or a lentivirus.

In some aspects, the present disclosure provides for a cell comprising the vector of any of the aspects or embodiments described herein.

In some aspects, the present disclosure provides for a method of manufacturing an endonuclease, comprising cultivating the cell of any of the aspects or embodiments described herein.

In some aspects, the present disclosure provides for a method for modifying a double-stranded deoxyribonucleic acid polynucleotide comprising contacting said double-stranded deoxyribonucleic acid polynucleotide with a complex comprising: an endonuclease comprising a RuvC domain and an HNH domain, wherein said endonuclease is derived from an uncultivated microorganism, wherein said endonuclease is a class 2, type II Cas endonuclease, and wherein the endonuclease is configured to be deficient in nuclease activity; a base editor coupled to said endonuclease; and an engineered guide ribonucleic acid structure configured to bind to said endonuclease and said double-stranded deoxyribonucleic acid polynucleotide; wherein said double-stranded deoxyribonucleic acid polynucleotide comprises a protospacer adjacent motif (PAM). In some embodiments, said endonuclease comprising a RuvC domain and an HNH domain is covalently coupled directly to said base editor or covalently coupled to said base editor through a linker. In some embodiments, said endonuclease comprising a RuvC domain and an HNH domain comprises a sequence with at least 95% sequence identity to any one of SEQ ID NOs:70-78 or 597 or a variant thereof.

In some aspects, the present disclosure provides for a method for modifying a double-stranded deoxyribonucleic acid polynucleotide, comprising contacting said double-stranded deoxyribonucleic acid polynucleotide with a complex comprising: a class 2, type II Cas endonuclease, a base editor coupled to said endonuclease, and an engineered guide ribonucleic acid structure configured to bind to said endonuclease and said double-stranded deoxyribonucleic acid polynucleotide; wherein said double-stranded deoxyribonucleic acid polynucleotide comprises a protospacer adjacent motif (PAM); and wherein said PAM comprises a sequence selected from the group consisting of SEQ ID NOs:70-78 or 597. In some embodiments, said class 2, type II Cas endonuclease is covalently coupled to said base editor or coupled to said base editor through a linker. In some embodiments, said base editor comprises a sequence with at least 70%, at least 80%, at least 90% or at least 95% identity to a sequence selected from SEQ ID NOs: 1-51, 57-66, 385-443, 444-475, or 594-595 or a variant thereof. In some embodiments, said base editor comprises an adenosine deaminase; said double-stranded deoxyribonucleic acid polynucleotide comprises an adenine; and modifying said double-stranded deoxyribonucleic acid polypeptide comprises converting said adenine to guanine. In some embodiments, said adenosine deaminase comprises a sequence with at least 70%, 80%, 90% or 95% sequence identity to any one of SEQ ID NOs: 50-51, 57, 385-443, 448-475, or 595 or a variant thereof. In some embodiments, said base editor comprises a cytosine deaminase; said double-stranded deoxyribonucleic acid polynucleotide comprises a cytosine; and modifying said double-stranded deoxyribonucleic acid polypeptide comprises converting said cytosine to uracil. In some embodiments, said cytosine deaminase comprises a sequence with at least 70%, 80%, 90% or 95% sequence identity to any one of SEQ ID NOs: 1-49, 444-447, 594, or 58-66 or a variant thereof. In some embodiments, said complex further comprises a uracil DNA glycosylase inhibitor coupled to said endonuclease or said base editor. In some embodiments, said uracil DNA glycosylase inhibitor comprises a sequence with at least 70%, 80%, 90% or 95% identity to any one of SEQ ID NOs: 52-56 or SEQ ID NO: 67 or a variant thereof. In some embodiments, said double-stranded deoxyribonucleic acid polynucleotide comprises a first strand comprising a sequence complementary to a sequence of said engineered guide ribonucleic acid structure and a second strand comprising said PAM. In some embodiments, said PAM is directly adjacent to the 3' end of said sequence complementary to said sequence of said engineered guide ribonucleic acid structure. In some embodiments, said class 2, type II Cas endonuclease is not a Cas9 endonuclease, a Cas14 endonuclease, a Cas12a endonuclease, a Cas12b endonuclease, a Cas12c endonuclease, a Cas12d endonuclease, a Cas12e endonuclease, a Cas13a endonuclease, a Cas13b endonuclease, a Cas13c endonuclease, or a Cas 13d endonuclease. In some embodiments, said class 2, type II Cas endonuclease is derived from an uncultivated microorganism. In some embodiments, said double-stranded deoxyribonucleic acid polynucleotide is a eukaryotic, plant, fungal, mammalian, rodent, or human double-stranded deoxyribonucleic acid polynucleotide.

In some aspects, the present disclosure provides for a method of modifying a target nucleic acid locus, said method comprising delivering to said target nucleic acid locus said engineered nucleic acid editing system of any of the aspects or embodiments described herein, wherein said endonuclease is configured to form a complex with said engineered guide ribonucleic acid structure, and wherein said complex is configured such that upon binding of said complex to said target nucleic acid locus, said complex modifies a nucleotide of said target nucleic locus. In some embodiments, said engineered nucleic acid editing system comprises an adenosine deaminase, said nucleotide is an adenine, and modifying said target nucleic acid locus comprises converting said adenine to a guanine. In some embodiments, said engineered nucleic acid editing system comprises a cytidine deaminase and a uracil DNA glycosylase inhibitor, said nucleotide is a cytosine and modifying said target nucleic acid locus comprises converting said adenine to a uracil. In some embodiments, said target nucleic acid locus comprises genomic DNA, viral DNA, or bacterial DNA. In some embodiments, said target nucleic acid locus is in vitro. In some embodiments, said target nucleic acid locus is within a cell. In some embodiments, said cell is a prokaryotic cell, a bacterial cell, a eukaryotic cell, a fungal cell, a plant cell, an animal cell, a mammalian cell, a rodent cell, a primate cell, or a human cell. In some embodiments, said cell is within an animal. In some embodiments, said cell is within a cochlea. In some embodiments, said cell is within an embryo. In some embodiments, said embryo is a two-cell embryo. In some embodiments, said embryo is a mouse embryo. In some embodiments, delivering said engineered nucleic acid editing system to said target nucleic acid locus comprises delivering the nucleic acid of any of the aspects or embodiments described herein or the vector of any of the aspects or embodiments described herein. In some embodiments, delivering said engineered nucleic acid editing system to said target nucleic acid locus comprises delivering a nucleic acid comprising an open reading frame encoding said endonuclease. In some embodiments, said nucleic acid comprises a promoter to which said open reading frame encoding said endonuclease is operably linked. In some embodiments, delivering said engineered nucleic acid editing system to said target nucleic acid locus comprises delivering a capped mRNA containing said open reading frame encoding said endonuclease. In some embodiments, delivering said engineered nucleic acid editing system to said target nucleic acid locus comprises delivering a translated polypeptide. In some embodiments, delivering said engineered nucleic acid editing system to said target nucleic acid locus comprises delivering a deoxyribonucleic acid (DNA) encoding said engineered guide ribonucleic acid structure operably linked to a ribonucleic acid (RNA) pol III promoter.

In some aspects, the present disclosure provides for an engineered nucleic acid editing polypeptide, comprising: an endonuclease comprising a RuvC domain and an HNH domain, wherein said endonuclease is derived from an uncultivated microorganism, wherein said endonuclease is a class 2, type II Cas endonuclease, and wherein the endonuclease is configured to be deficient in nuclease activity; and a base editor coupled to said endonuclease. In some embodiments, said endonuclease comprises a sequence with at least 95% sequence identity to any one of SEQ ID NOs:70-78 or 597 or a variant thereof.

In some aspects, the present disclosure provides for an engineered nucleic acid editing polypeptide, comprising: an endonuclease having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs:70-78 or 597 or a variant thereof, wherein the endonuclease is configured to be deficient in nuclease activity; and a base editor coupled to said endonuclease. In some aspects, the present disclosure provides for an engineered nucleic acid editing polypeptide, comprising: an endonuclease configured to bind to a protospacer adjacent motif (PAM) sequence comprising any one of SEQ ID NOs: 360-368 or 598, wherein said endonuclease is a class 2, type II Cas endonuclease, and wherein the endonuclease is configured to be deficient in nuclease activity.; and a base editor coupled to said endonuclease. In some embodiments, said endonuclease is derived from an uncultivated microorganism. In some embodiments, said endonuclease has less than 80% identity to a Cas9 endonuclease. In some embodiments, said endonuclease further comprises an HNH domain. In some embodiments, said tracr ribonucleic acid sequence comprises a sequence with at least 80% sequence identity to about 60 to 90 consecutive nucleotides selected from any one of SEQ ID NOs: 88-96, 488, and 489. In some embodiments, said base editor comprises a sequence with at least 70%, 80%, 90% or 95% identity to any one of SEQ ID NOs: 1-51, 57-66, 385-443, 444-475, or 594-595 or a variant thereof. In some embodiments, said base editor is an adenosine deaminase. In some embodiments, said adenosine deaminase comprises a sequence with at least 70%, 80%, 90% or 95% sequence identity to any one of SEQ ID NOs: 50-51, 57, 385-443, 448-475, or 595 or a variant thereof. In some embodiments, said base editor is a cytosine deaminase. In some embodiments, said cytosine deaminase comprises a sequence with at least 70%, 80%, 90% or 95% sequence identity to any one of SEQ ID NOs: 1-49, 444-447, 594, or 58-66 or a variant thereof.

In some aspects, the present disclosure provides for an engineered nucleic acid editing polypeptide, comprising: an endonuclease, wherein said endonuclease is configured to be deficient in endonuclease activity; and a base editor coupled to said endonuclease, wherein said base editor comprises a sequence with at least 70%, 80%, 90% or 95% sequence identity to any one of SEQ ID NOs: 1-51, 385-386, 387-443, 444-447, 488-475, or 595, or a variant thereof. In some embodiments, said endonuclease is configured to cleave one strand of a double-stranded target deoxyribonucleic acid. In some embodiments, said endonuclease is configured to be catalytically dead. In some embodiments, said endonuclease is a Cas endonuclease. In some embodiments, said Cas endonuclease is a Class II, type II Cas endonuclease or a Class II, type V Cas endonuclease. In some embodiments, said endonuclease comprises a sequence having at least 70%, 80%, 90% or 95% sequence identity to any one of SEQ ID NOs:70-78 or 597 or a variant thereof. In some embodiments, said Cas endonuclease comprises a nickase mutation. In some embodiments, said Cas endonuclease comprises the aspartate to alanine mutation at residue 9 relative to SEQ ID NO: 70, residue 13 relative to SEQ ID NOs: 71, 72, or 74, residue 12 relative to SEQ ID NO: 73, residue 17 relative to SEQ ID NO: 75, residue 23 relative to SEQ ID NO: 76, or residue 10 relative to SEQ ID NO: 597 when optimally aligned. In some embodiments, said endonuclease is configured to bind to a protospacer adjacent motif (PAM) sequence selected from the group consisting of SEQ ID NOs: 360-368 or 598. In some embodiments, said base editor is an adenosine deaminase. In some embodiments, said adenosine deaminase comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs: 50-51, 385-443, or 448-475 or a variant thereof. In some embodiments, said adenosine deaminase comprises a sequence with at least 70%, 80%, 90% or 95% identity to any one of SEQ ID NOs: 50-51, 385-390, or 595, or a variant thereof. In some embodiments, said base editor is a cytosine deaminase. In some embodiments, said cytosine deaminase comprises a sequence with at least 70%, 80%, 90% or 95% identity to any one of SEQ ID NOs: 1-49, 444-447 or a variant thereof. In some embodiments, the polypeptide further comprises a uracil DNA glycosylase inhibitor coupled to said endonuclease or said base editor. In some embodiments, said uracil DNA glycosylase inhibitor comprises a sequence with at least 70%, 80%, 90% or 95% identity to any one of SEQ ID NOs: 52-56 or SEQ ID NO: 67 or a variant thereof. In some embodiments, said endonuclease comprises one or more nuclear localization sequences (NLSs) proximal to an N- or C-terminus of said endonuclease. In some embodiments, said NLS comprises a sequence with at least 90% identity to a selected from SEQ ID NOs: 369-384 or a variant thereof. In some embodiments, said endonuclease is covalently coupled directly to said base editor or covalently coupled to said base editor through a linker.

In some aspects, the present disclosure provides for a nucleic acid comprising an engineered nucleic acid sequence optimized for expression in an organism, wherein said nucleic acid encodes a sequence having at least 70%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs: 1-51, 385-386, 387-443, 444-447, or 488-475 or a variant thereof. In some embodiments, said organism is prokaryotic, bacterial, eukaryotic, fungal, plant, mammalian, rodent, or human.

In some aspects, the present disclosure provides for a vector comprising the nucleic acid of any of the aspects or embodiments described herein. In some embodiments, the vector is a plasmid, a minicircle, a CELiD, an adeno-associated virus (AAV) derived virion, or a lentivirus.

In some aspects, the present disclosure provides for a cell comprising the vector of any one of the aspects or embodiments described herein.

In some aspects, the present disclosure provides for a method of manufacturing a base editor, comprising cultivating said cell of any one of the aspects or embodiments described herein.

In some aspects, the present disclosure provides for a system comprising: (a) the nucleic acid editing polypeptide of any of the aspects or embodiments described herein; and (b) an engineered guide ribonucleic acid structure configured to form a complex with said nucleic acid editing polypeptide comprising: a guide ribonucleic acid sequence configured to hybridize to a target deoxyribonucleic acid sequence; and a ribonucleic acid sequence configured to bind to said endonuclease. In some embodiments, said engineered guide ribonucleic acid sequence comprises a sequence with at least 80% sequence identity to non-degenerate nucleotides of any one of SEQ ID NOs: 88-96 or 488-489.

In some aspects, the present disclosure provides for a method of modifying a target nucleic acid locus, said method comprising delivering to said target nucleic acid locus said engineered nucleic acid editing polypeptide of any of the aspects or embodiments described herein or said system of any of the aspects or embodiments described herein, wherein said complex is configured such that upon binding of said complex to said target nucleic acid locus, said complex modifies a nucleotide of said target nucleic acid locus.

In some aspects, the present disclosure provides for an engineered nucleic acid editing system, comprising: (a) an endonuclease comprising a RuvC domain and an HNH domain, wherein the endonuclease is derived from an uncultivated microorganism, wherein the endonuclease is a class 2, type II Cas endonuclease, and wherein the RuvC domain lacks nuclease activity; (b) a base editor coupled to the endonuclease; and (c) an engineered guide ribonucleic acid structure configured to form a complex with the endonuclease comprising: (i) a guide ribonucleic acid sequence configured to hybridize to a target deoxyribonucleic acid sequence; and (ii) a tracr ribonucleic acid sequence configured to bind to the endonuclease. In some embodiments, the endonuclease comprises a sequence with at least 95% sequence identity to any one of SEQ ID NOs: 70-78.

In some aspects, the present disclosure provides for an engineered nucleic acid editing system comprising: (a) an endonuclease having at least 95% sequence identity to any one of SEQ ID NOs: 70-78, wherein the endonuclease comprises a RuvC domain lacking nuclease activity; a base editor coupled to the endonuclease; and an engineered guide ribonucleic acid structure configured to form a complex with the endonuclease comprising: (i) a guide ribonucleic acid sequence configured to hybridize to a target deoxyribonucleic acid sequence; and (ii) a tracr ribonucleic acid sequence configured to bind to the endonuclease.

In some aspects, the present disclosure provides for an engineered nucleic acid editing system comprising: (a) an endonuclease configured to bind to a protospacer adjacent motif (PAM) sequence comprising SEQ ID NOs: 360-368, wherein the endonuclease is a class 2, type II Cas endonuclease, and wherein the endonuclease comprises a RuvC domain lacking nuclease activity; and (b) a base editor coupled to the endonuclease; and (c) an engineered guide ribonucleic acid structure configured to form a complex with the endonuclease comprising: (i) a guide ribonucleic acid sequence configured to hybridize to a target deoxyribonucleic acid sequence; and (ii) a tracr ribonucleic acid sequence configured to bind to the endonuclease.

In some embodiments, the endonuclease is derived from an uncultivated microorganism. In some embodiments, the endonuclease has less than 80% identity to a Cas9 endonuclease. In some embodiments, the endonuclease further comprises an HNH domain. In some embodiments, the tracr ribonucleic acid sequence comprises a sequence with at least 80% sequence identity to about 60 to 90 consecutive nucleotides selected from any one of SEQ ID NOs: 88-96, 488, and 489.

In some aspects, the present disclosure provides an engineered nucleic acid editing system comprising, (a) an engineered guide ribonucleic acid structure comprising: (i) a guide ribonucleic acid sequence configured to hybridize to a target deoxyribonucleic acid sequence; and (ii) a tracr ribonucleic acid sequence configured to bind to an endonuclease, wherein the tracr ribonucleic acid sequence comprises a sequence with at least 80% sequence identity to about 60 to 90 consecutive nucleotides selected from any one of SEQ ID NOs: 88-96, 488, and 489; and a class 2, type II Cas endonuclease configured to bind to the engineered guide ribonucleic acid.

In some embodiments, the endonuclease is configured to bind to a protospacer adjacent motif (PAM) sequence selected from the group consisting of SEQ ID NOs: 360-368. In some embodiments, the base editor comprises a sequence with at least 70%, 80%, 90% or 95% identity to any one of SEQ ID NOs: 1-51 and 385-475. In some embodiments, the base editor is an adenosine deaminase. In some embodiments, the adenosine deaminase comprises a sequence with at least 95% identity to SEQ ID NO: 57. In some embodiments, the base editor is a cytosine deaminase. In some embodiments, the cytosine deaminase comprises a sequence with at least 95% identity to SEQ ID NO: 58. In some embodiments, the cytosine deaminase comprises a sequence with at least 95% identity to any one of SEQ ID NOs: 59-66.

In some embodiments, the engineered nucleic acid editing system further comprises a uracil DNA glycosylase inhibitor. In some embodiments, the uracil DNA glycosylase inhibitor comprises a sequence with at least 70%, 80%, 90% or 95% identity to any one of SEQ ID NOs: 52-56 or SEQ ID NO: 67.

In some embodiments, the engineered guide ribonucleic acid structure comprises at least two ribonucleic acid polynucleotides. In some embodiments, the engineered guide ribonucleic acid structure comprises one ribonucleic acid polynucleotide comprising the guide ribonucleic acid sequence and the tracr ribonucleic acid sequence. In some embodiments, the guide ribonucleic acid sequence is complementary to a prokaryotic, bacterial, archaeal, eukaryotic, fungal, plant, mammalian, or human genomic sequence. In some embodiments, the guide ribonucleic acid sequence is 15-24 nucleotides in length. In some embodiments, the endonuclease comprises one or more nuclear localization sequences (NLSs) proximal to an N- or C-terminus of said endonuclease. In some embodiments, the endonuclease is covalently coupled directly to the base editor or covalently coupled to the base editor through a linker. In some embodiments, a polypeptide comprises the endonuclease and the base editor. In some embodiments, the endonuclease is configured to cleave one strand of a double-stranded target deoxyribonucleic acid. In some embodiments, the endonuclease comprises SEQ ID NO: 370. In some embodiments, the system further comprises a source of $Mg^{2+}$.

In some embodiments, the endonuclease comprises a sequence at least 70%, at least 80%, or at least 90% identical to SEQ ID NO: 70; the guide RNA structure comprises a sequence at least 70%, at least 80%, or at least 90% identical to SEQ ID NO: 88; and the endonuclease is configured to bind to a PAM comprising SEQ ID NO: 360.

In some embodiments, the endonuclease comprises a sequence at least 70%, at least 80%, or at least 90% identical to SEQ ID NO: 71; the guide RNA structure comprises a sequence at least 70%, at least 80%, or at least 90% identical to SEQ ID NO: 89; and the endonuclease is configured to bind to a PAM comprising SEQ ID NO: 361.

In some embodiments, the endonuclease comprises a sequence at least 70%, at least 80%, or at least 90% identical to SEQ ID NO: 73; the guide RNA structure comprises a sequence at least 70%, at least 80%, or at least 90% identical to SEQ ID NO: 91; and the endonuclease is configured to bind to a PAM comprising SEQ ID NO: 363.

In some embodiments, the endonuclease comprises a sequence at least 70%, at least 80%, or at least 90% identical to SEQ ID NO: 75; the guide RNA structure comprises a sequence at least 70%, at least 80%, or at least 90% identical to SEQ ID NO: 93; and the endonuclease is configured to bind to a PAM comprising SEQ ID NO: 365.

In some embodiments, the endonuclease comprises a sequence at least 70%, at least 80%, or at least 90% identical to SEQ ID NO: 76; the guide RNA structure comprises a sequence at least 70%, at least 80%, or at least 90% identical to SEQ ID NO: 94; and the endonuclease is configured to bind to a PAM comprising SEQ ID NO: 366.

In some embodiments, the endonuclease comprises a sequence at least 70%, at least 80%, or at least 90% identical to SEQ ID NO: 77; the guide RNA structure comprises a sequence at least 70%, at least 80%, or at least 90% identical to SEQ ID NO: 95; and the endonuclease is configured to bind to a PAM comprising SEQ ID NO: 367.

In some embodiments, the endonuclease comprises a sequence at least 70%, at least 80%, or at least 90% identical to SEQ ID NO: 78; the guide RNA structure comprises a sequence at least 70%, at least 80%, or at least 90% identical to SEQ ID NO: 96; and the endonuclease is configured to bind to a PAM comprising SEQ ID NO: 368.

In some embodiments, the base editor comprises an adenosine deaminase. In some embodiments, the adenosine deaminase comprises SEQ ID NO: 57. In some embodiments, the base editor comprises a cytosine deaminase. In some embodiments, the cytosine deaminase comprises SEQ ID NO: 58. In some embodiments, the engineered nucleic acid editing system described herein further comprises a uracil DNA glycosylation inhibitor. In some embodiments, the uracil DNA glycosylation inhibitor comprises SEQ ID NO: 67.

In some embodiments, the sequence identity is determined by a BLASTP, CLUSTALW, MUSCLE, MAFFT, or Smith-Waterman homology search algorithm. In some embodiments, the sequence identity is determined by said BLASTP homology search algorithm using parameters of a wordlength (W) of 3, an expectation (E) of 10, and a BLOSUM62 scoring matrix setting gap costs at existence of 11, extension of 1, and using a conditional compositional score matrix adjustment.

In some aspects, the present disclosure provides a nucleic acid comprising an engineered nucleic acid sequence optimized for expression in an organism, wherein the nucleic acid encodes a class 2, type II Cas endonuclease coupled to a base editor, and wherein the endonuclease is derived from an uncultivated microorganism.

In some aspects, the present disclosure provides a nucleic acid comprising an engineered nucleic acid sequence optimized for expression in an organism, wherein the nucleic acid encodes an endonuclease having at least 70% sequence identity to any one of SEQ ID NOs: 70-78 coupled to a base editor. In some embodiments, the endonuclease comprises a sequence encoding one or more nuclear localization sequences (NLSs) proximal to an N- or C-terminus of said endonuclease. In some embodiments, the organism is prokaryotic, bacterial, eukaryotic, fungal, plant, mammalian, rodent, or human.

In some aspects, the present disclosure provides a vector comprising a nucleic acid sequence encoding a class 2, type II Cas endonuclease coupled to a base editor, wherein said endonuclease is derived from an uncultivated microorganism. In some embodiments, the vector comprises the nucleic acid described herein. In some embodiments, the vector further comprises a nucleic acid encoding an engineered guide ribonucleic acid structure configured to form a complex with the endonuclease comprising: a guide ribonucleic acid sequence configured to hybridize to a target deoxyribonucleic acid sequence; and a tracr ribonucleic acid sequence configured to binding to the endonuclease. In some embodiments, the vector is a plasmid, a minicircle, a CELiD, an adeno-associated virus (AAV) derived virion, or a lentivirus. In some aspects, the present disclosure provides a cell comprising the vector described herein. In some aspects, the present disclosure provides a method of manufacturing an endonuclease, comprising cultivating the cell described herein.

In some aspects, the present disclosure provides a method for modifying a double-stranded deoxyribonucleic acid polynucleotide comprising contacting the double-stranded deoxyribonucleic acid polynucleotide with a complex comprising: an endonuclease comprising a RuvC domain and an HNH domain, wherein the endonuclease is derived from an uncultivated microorganism, wherein the endonuclease is a class 2, type II Cas endonuclease, and wherein the RuvC domain lacks nuclease activity; a base editor coupled to the endonuclease; and an engineered guide ribonucleic acid structure configured to bind to the endonuclease and the double-stranded deoxyribonucleic acid polynucleotide; wherein the double-stranded deoxyribonucleic acid polynucleotide comprises a protospacer adjacent motif (PAM).

In some embodiments, the endonuclease comprising a RuvC domain and an HNH domain is covalently coupled directly to the base editor or covalently coupled to the base editor through a linker. In some embodiments, the endonuclease comprising a RuvC domain and an HNH domain comprises a sequence with at least 95% sequence identity to any one of SEQ ID NOs: 70-78.

In some aspects, the present disclosure provides a method for modifying a double-stranded deoxyribonucleic acid polynucleotide, comprising contacting the double-stranded deoxyribonucleic acid polynucleotide with a complex comprising: a class 2, type II Cas endonuclease, a base editor coupled to the endonuclease, and an engineered guide ribonucleic acid structure configured to bind to the endonuclease and the double-stranded deoxyribonucleic acid polynucleotide; wherein the double-stranded deoxyribonucleic acid polynucleotide comprises a protospacer adjacent motif (PAM); and wherein the PAM comprises a sequence selected from the group consisting of SEQ ID NOs: 360-368.

In some embodiments, the class 2, type II Cas endonuclease is covalently coupled to the base editor or coupled to the base editor through a linker. In some embodiments, the base editor comprises a sequence with at least 70%, at least 80%, at least 90% or at least 95% identity to a sequence selected from SEQ ID NOs: 1-51 and 385-475. In some embodiments, the base editor comprises an adenosine deaminase; the double-stranded deoxyribonucleic acid polynucleotide comprises an adenine; and modifying the double-stranded deoxyribonucleic acid polypeptide comprises converting the adenine to guanine. In some embodiments, the adenosine deaminase comprises a sequence with at least 95% identity to SEQ ID NO: 57.

In some embodiments, the base editor comprises a cytosine deaminase; the double-stranded deoxyribonucleic acid polynucleotide comprises a cytosine; and modifying the double-stranded deoxyribonucleic acid polypeptide comprises converting the cytosine to uracil. In some embodiments, the cytosine deaminase comprises a sequence with at least 95% identity to SEQ ID NO: 58. In some embodiments, the cytosine deaminase comprises a sequence with at least 95% identity to any one of SEQ ID NOs: 59-66.

In some embodiments, the complex further comprises a uracil DNA glycosylase inhibitor. In some embodiments, the uracil DNA glycosylase inhibitor comprises a sequence with at least 70%, 80%, 90% or 95% identity to any one of SEQ ID NOs: 52-56 or SEQ ID NO: 67. In some embodiments, the double-stranded deoxyribonucleic acid polynucleotide comprises a first strand comprising a sequence complementary to a sequence of the engineered guide ribonucleic acid structure and a second strand comprising said PAM. In some embodiments, the PAM is directly adjacent to the 3' end of the sequence complementary to the sequence of the engineered guide ribonucleic acid structure.

In some embodiments, the class 2, type II Cas endonuclease is not a Cas9 endonuclease, a Cas14 endonuclease, a Cas12a endonuclease, a Cas12b endonuclease, a Cas 12c endonuclease, a Cas12d endonuclease, a Cas12e endonuclease, a Cas13a endonuclease, a Cas13b endonuclease, a Cas13c endonuclease, or a Cas 13d endonuclease. In some embodiments, the class 2, type II Cas endonuclease is derived from an uncultivated microorganism. In some embodiments, the double-stranded deoxyribonucleic acid polynucleotide is a eukaryotic, plant, fungal, mammalian, rodent, or human double-stranded deoxyribonucleic acid polynucleotide.

In some aspects, the present disclosure provides a method of modifying a target nucleic acid locus, said method comprising delivering to said target nucleic acid locus the engineered nucleic acid editing system described herein, wherein the endonuclease is configured to form a complex with the engineered guide ribonucleic acid structure, and wherein the complex is configured such that upon binding of the complex to the target nucleic acid locus, the complex modifies a nucleotide of the target nucleic locus.

In some embodiments, the engineered nucleic acid editing system comprises an adenosine deaminase, the nucleotide is an adenine, and modifying the target nucleic acid locus comprises converting the adenine to a guanine. In some embodiments, the engineered nucleic acid editing system comprises a cytidine deaminase and a uracil DNA glycosylase inhibitor, the nucleotide is a cytosine and modifying the target nucleic acid locus comprises converting the adenine to a uracil. In some embodiments, the target nucleic acid locus comprises genomic DNA, viral DNA, or bacterial DNA. In some embodiments, the target nucleic acid locus is in vitro. In some embodiments, the target nucleic acid locus is within a cell. In some embodiments, the cell is a prokaryotic cell, a bacterial cell, a eukaryotic cell, a fungal cell, a plant cell, an animal cell, a mammalian cell, a rodent cell, a primate cell, or a human cell. In some embodiments, the cell is within an animal.

In some embodiments, the cell is within a cochlea. In some embodiments, the cell is within an embryo. In some embodiments, the embryo is a two-cell embryo. In some embodiments, the embryo is a mouse embryo. In some embodiments, delivering the engineered nucleic acid editing system to the target nucleic acid locus comprises delivering the nucleic acid described herein or the vector described herein. In some embodiments, delivering the engineered nucleic acid editing system to the target nucleic acid locus comprises delivering a nucleic acid comprising an open reading frame encoding the endonuclease.

In some embodiments, the nucleic acid comprises a promoter to which the open reading frame encoding the endonuclease is operably linked. In some embodiments, delivering the engineered nucleic acid editing system to said target nucleic acid locus comprises delivering a capped mRNA containing the open reading frame encoding the endonuclease. In some embodiments, delivering the engineered nucleic acid editing system to the target nucleic acid locus comprises delivering a translated polypeptide. In some embodiments, delivering the engineered nucleic acid editing system to the target nucleic acid locus comprises delivering a deoxyribonucleic acid (DNA) encoding the engineered guide ribonucleic acid structure operably linked to a ribonucleic acid (RNA) pol III promoter.

In some aspects, the present disclosure provides an engineered nucleic acid editing polypeptide, comprising: an endonuclease comprising a RuvC domain and an HNH domain, wherein the endonuclease is derived from an uncultivated microorganism, wherein the endonuclease is a class 2, type II Cas endonuclease, and wherein the RuvC domain lacks nuclease activity; and a base editor coupled to the endonuclease. In some embodiments, the endonuclease comprises a sequence with at least 95% sequence identity to any one of SEQ ID NOs: 70-78.

In some aspects, the present disclosure provides an engineered nucleic acid editing polypeptide, comprising: an endonuclease having at least 95% sequence identity to any one of SEQ ID NOs: 70-78, wherein the endonuclease comprises a RuvC domain lacking nuclease activity; and a base editor coupled to the endonuclease.

In some aspects, the present disclosure provides an engineered nucleic acid editing polypeptide, comprising: an endonuclease configured to bind to a protospacer adjacent motif (PAM) sequence comprising SEQ ID NOs: 360-368, wherein the endonuclease is a class 2, type II Cas endonuclease, and wherein the endonuclease comprises a RuvC domain lacks nuclease activity; and a base editor coupled to the endonuclease.

In some embodiments, the endonuclease is derived from an uncultivated microorganism. In some embodiments, the endonuclease has less than 80% identity to a Cas9 endonuclease. In some embodiments, the endonuclease further comprises an HNH domain. In some embodiments, the tracr ribonucleic acid sequence comprises a sequence with at least 80% sequence identity to about 60 to 90 consecutive nucleotides selected from any one of SEQ ID NOs: 88-96, 488, and 489. In some embodiments, the base editor comprises a sequence with at least 70%, 80%, 90% or 95% identity to any one of SEQ ID NOs: 1-51 and 385-475. In some embodiments, the base editor is an adenosine deaminase. In some embodiments, the adenosine deaminase comprises a sequence with at least 95% identity to SEQ ID NO: 57. In some embodiments, the base editor is a cytosine deaminase. In some embodiments, the cytosine deaminase comprises a sequence with at least 95% identity to SEQ ID NO: 58. In some embodiments, the adenosine cytosine deaminase comprises a sequence with at least 95% identity to any one of SEQ ID NOs: 59-66.

Additional aspects and advantages of the present disclosure will become readily apparent to those skilled in this art from the following detailed description, wherein only illustrative embodiments of the present disclosure are shown and described. As will be realized, the present disclosure is capable of other and different embodiments, and its several details are capable of modifications in various obvious respects, all without departing from the disclosure. Accordingly, the drawings and description are to be regarded as illustrative in nature, and not as restrictive.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings (also "Figure" and "FIG." herein), of which:

Figure 6A:
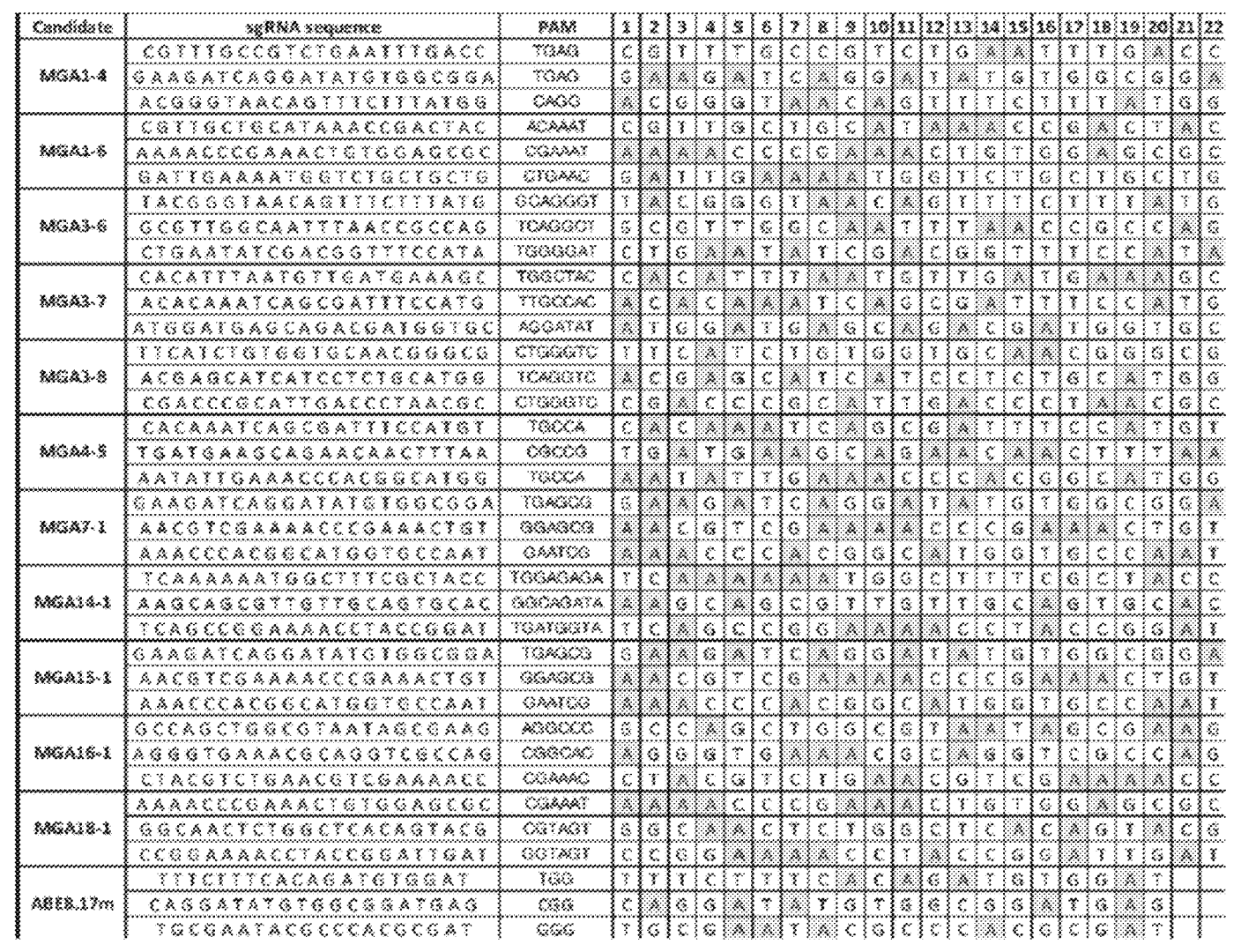

FIGS. 6A and 6B show sgRNA designs for lacZ targeting in E. coli. The spacer length used for the systems described herein was 22 nucleotides. For selected systems described herein, three sgRNAs targeting lacZ in E. coli were designed to determine editing windows. FIG. 6A (left column) discloses SEQ ID NOS 613-630, 614, 631-635, 614, 631, 632, 636-638, 617, and 639-643, respectively, in order of appearance. FIG. 6A (right column) discloses SEQ ID NOS 613-630, 614, 631-635, 614, 631, 632, 636-638, 617, and 639-643, respectively, in order of appearance. FIG. 6B (left column) discloses SEQ ID NOS 644-648, 638, 649-654, 625-627, 655, 628, 656-662, 657-659, 663-665, 646, and 666-670, respectively, in order of appearance. FIG. 6B (right column) discloses SEQ ID NOS 644-648, 638, 649-654, 625-627, 655, 628, 656-662, 657-659, 663-665, 646, and 666-670, respectively in order of appearance.

FIGS. 10A and 10B show base editing efficiencies of adenine base editors (ABEs) comprising TadA (ABE8.17m) and MG nickases. TadA is a tRNA adenosine deaminase, and TadA (ABE8.17m) is an engineered variant of E. coli TadA. 12 MG nickases fused with TadA (ABE8.17m) were constructed and tested in E. coli. Three guides were designed to target lacZ. Numbers shown in boxes indicate percentages of A to G conversion quantified by Edit R. ABE8.17m was used as the positive control for the experiment. FIG. 10A discloses SEQ ID NOS 613-630, 614, 631-635, 614, 631, and 632, from top to bottom, left to right, respectively, in order of appearance. FIG. 10B discloses SEQ ID NOS 636-638, 617, and 639-643, respectively, in order of appearance.

FIGS. 11A and 11B show base editing efficiencies of cytosine base editors (CBEs) comprising rat APOBEC1, MG nickases, and the uracil glycosylase inhibitor of Bacillus subtilis bacteriophage (UGI (PBS1)). APOBEC1 is a cytosine deaminase. 12 MG nickases fused to rAPOBEC1 on their N-terminus and UGI on their C-terminus were constructed and tested in E. coli. Three guides were designed to target lacZ. The numbers shown in boxes indicate percentages of C to T conversion quantified by Edit R. BE3 was used as the positive control in the experiment. FIG. 11A discloses SEQ ID NOS 644-648, 638, 649-654, 625-627, 655, 628, 656-662, and 657-659, from top to bottom, left to right, respectively, in order of appearance. FIG. 11B discloses SEQ ID NOS 663-665, 646, and 666-670, respectively in order of appearance.[0072]

FIG. 13A discloses SEQ ID NOS 671-685, respectively, in order of appearance. FIG. 13B discloses SEQ ID NOS 686-691, respectively, in order of appearance.

FIG. 16B summarizes the editing efficiencies of MG TadA candidates and demonstrates that MG68-3, and MG68-4 drove base edits of adenine.

FIG. 19 shows 28 MG68-4 variants designed for improvements of MG68-4-nMG34-1 base editing activity (SEQ ID NOs: 448-475). 12 residues were selected for targeted mutagenesis to improve editing of the enzymes.

BRIEF DESCRIPTION OF THE SEQUENCE LISTING

Figure 1:
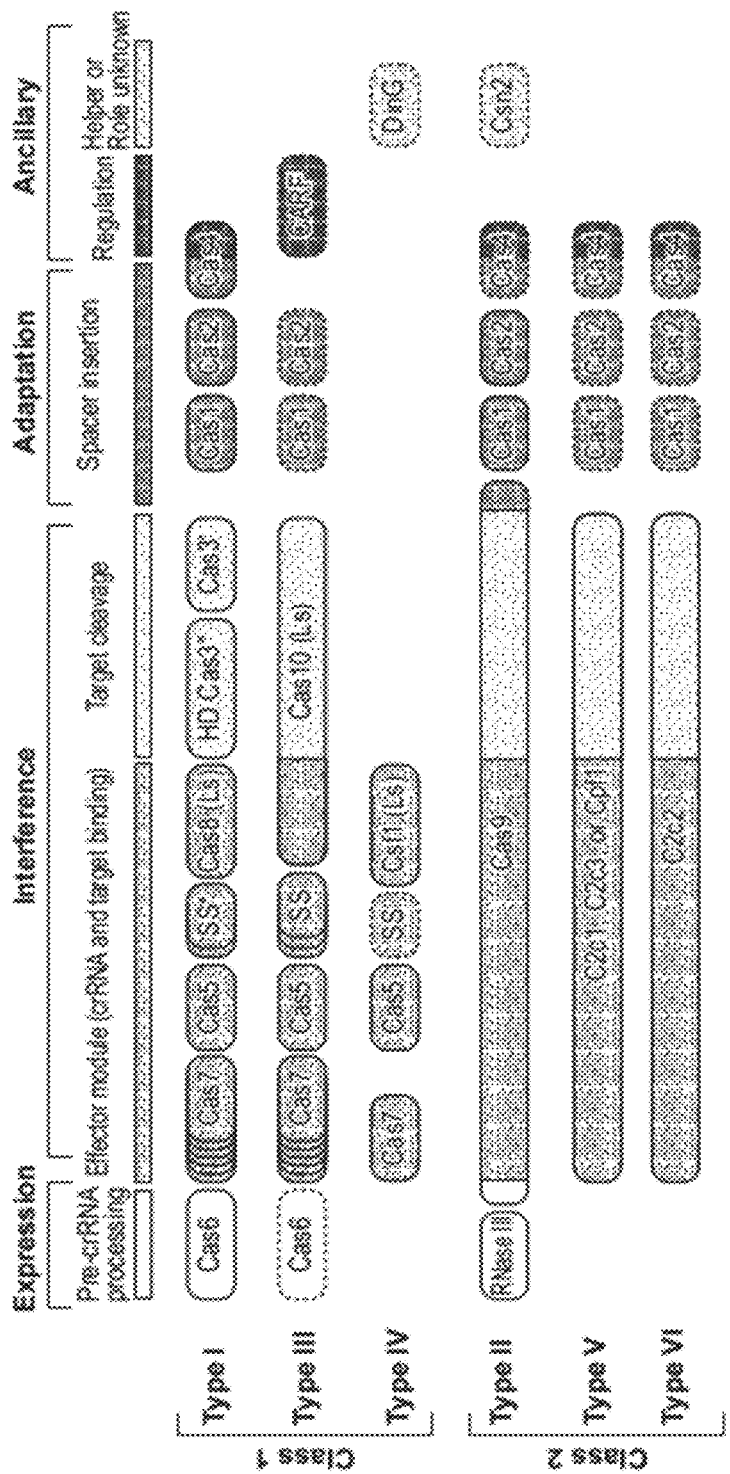
FIG. 1 depicts typical organizations of CRISPR/Cas loci of different classes and types.

The Sequence Listing filed herewith provides exemplary polynucleotide and polypeptide sequences for use in methods, compositions and systems according to the disclosure. Below are exemplary descriptions of sequences therein.

SEQ ID NOs: 1-47 show the full-length peptide sequences of MG66 deaminases suitable for the engineered nucleic acid editing systems described herein.

SEQ ID NOs: 48-49 show the full-length peptide sequences of MG67 deaminases suitable for the engineered nucleic acid editing systems described herein.

SEQ ID NOs: 50-51 show the full-length peptide sequences of MG68 deaminases suitable for the engineered nucleic acid editing systems described herein.

SEQ ID NOs: 52-56 show the sequences of uracil DNA glycosylase inhibitors suitable for the engineered nucleic acid editing systems described herein.

SEQ ID NOs: 57-66 show the sequences of reference deaminases.

SEQ ID NO: 67 shows the sequence of a reference uracil DNA glycosylase inhibitor.

SEQ ID NO: 68 shows the sequence of an adenine base editor.

SEQ ID NO: 69 shows the sequence of a cytosine base editor.

SEQ ID NOs: 70-78 show the full-length peptide sequences of MG nickases suitable for the engineered nucleic acid editing systems described herein.

SEQ ID NOs: 79-87 shows the protospacer and PAM used in in vitro nickase assays described herein.

SEQ ID NOs: 88-96 show the peptide sequences of single guide RNA used in in vitro nickase assays described herein.

SEQ ID NOs: 97-156 show the sequences of spacers when targeting *E. coli* lacZ.

SEQ ID NOs: 157-176 show the sequences of primers when conducting site directed mutagenesis.

SEQ ID NOs: 177-178 show the sequences of primers for lacZ sequencing.

SEQ ID NOs: 179-342 show the sequences of primers used during amplification.

SEQ ID NOs: 343-345 show the sequences of primers for lacZ sequencing.

SEQ ID NOs: 346-359 show the sequences of primers used during amplification.

SEQ ID NOs: 360-368 show protospacer adjacent motifs suitable for the engineered nucleic acid editing systems described herein.

SEQ ID NOs: 369-384 show nuclear localization sequences (NLS's) suitable for the engineered nucleic acid editing systems described herein.

SEQ ID NOs: 385-443 show the full-length peptide sequences of MG68 deaminases suitable for the engineered nucleic acid editing systems described herein.

SEQ ID NOs: 444-447 show the full-length peptide sequences of MG121 deaminases suitable for the engineered nucleic acid editing systems described herein.

SEQ ID NOs: 448-475 show the full-length peptide sequences of MG68 deaminases suitable for the engineered nucleic acid editing systems described herein.

SEQ ID NOs: 476 and 477 show sequences of adenine base editors.

SEQ ID NOs: 478-482 show sequences of cytosine base editors.

SEQ ID NOs: 483-487 show the sequences of plasmids suitable for encoding the engineered nucleic acid editing systems described herein.

SEQ ID NOs: 488 and 489 show the sgRNA scaffold sequences for MG15-1 and MG34-1.

SEQ ID NOs: 490-522 show the sequences of spacers used to target genomic loci in *E. coli* and HEK293T cells.

SEQ ID NOs: 523-585 show the sequences of primers used during amplification and Sanger sequencing.

DETAILED DESCRIPTION

While various embodiments of the invention have been shown and described herein, it will be obvious to those skilled in the art that such embodiments are provided by way of example only.

Numerous variations, changes, and substitutions may occur to those skilled in the art without departing from the invention. It should be understood that various alternatives to the embodiments of the invention described herein may be employed.

The practice of some methods disclosed herein employ, unless otherwise indicated, techniques of immunology, biochemistry, chemistry, molecular biology, microbiology, cell biology, genomics and recombinant DNA. See for example Sambrook and Green, Molecular Cloning: A Laboratory Manual, 4th Edition (2012); the series Current Protocols in Molecular Biology (F. M. Ausubel, et al. eds.); the series Methods In Enzymology (Academic Press, Inc.), PCR 2: A Practical Approach (M. J. MacPherson, B. D. Hames and G. R. Taylor eds. (1995)), Harlow and Lane, eds. (1988) Antibodies, A Laboratory Manual, and Culture of Animal Cells: A Manual of Basic Technique and Specialized Applications, 6th Edition (R. I. Freshney, ed. (2010)) (which is entirely incorporated by reference herein).

As used herein, the singular forms "a", "an" and "the" are intended to include the plural forms as well, unless the context clearly indicates otherwise. Furthermore, to the extent that the terms "including", "includes", "having", "has", "with", or variants thereof are used in either the detailed description and/or the claims, such terms are intended to be inclusive in a manner similar to the term "comprising."

The term "about" or "approximately" means within an acceptable error range for the particular value as determined by one of ordinary skill in the art, which will depend in part on how the value is measured or determined, i.e., the limitations of the measurement system. For example, "about" can mean within one or more than one standard deviation, per the practice in the art. Alternatively, "about" can mean a range of up to 20%, up to 15%, up to 10%, up to 5%, or up to 1% of a given value.

As used herein, a "cell" generally refers to a biological cell. A cell may be the basic structural, functional and/or biological unit of a living organism. A cell may originate from any organism having one or more cells. Some non-limiting examples include: a prokaryotic cell, eukaryotic cell, a bacterial cell, an archaeal cell, a cell of a single-cell eukaryotic organism, a protozoa cell, a cell from a plant (e.g., cells from plant crops, fruits, vegetables, grains, soy bean, corn, maize, wheat, seeds, tomatoes, rice, cassava, sugarcane, pumpkin, hay, potatoes, cotton, *cannabis*, tobacco, flowering plants, conifers, gymnosperms, ferns, clubmosses, hornworts, liverworts, mosses), an algal cell, (e.g., *Botryococcus braunii, Chlamydomonas reinhardtii, Nannochloropsis gaditana, Chlorella pyrenoidosa, Sargassum patens* C. Agardh, and the like), seaweeds (e.g., kelp), a fungal cell (e.g., a yeast cell, a cell from a mushroom), an animal cell, a cell from an invertebrate animal (e.g., fruit fly, cnidarian, echinoderm, nematode, etc.), a cell from a vertebrate animal (e.g., fish, amphibian, reptile, bird, mammal), a cell from a mammal (e.g., a pig, a cow, a goat, a sheep, a rodent, a rat, a mouse, a non-human primate, a human, etc.), and etcetera. Sometimes a cell is not originating from a natural organism (e.g., a cell can be a synthetically made, sometimes termed an artificial cell).

The term "nucleotide," as used herein, generally refers to a base-sugar-phosphate combination. A nucleotide may comprise a synthetic nucleotide. A nucleotide may comprise a synthetic nucleotide analog. Nucleotides may be monomeric units of a nucleic acid sequence (e.g., deoxyribonucleic acid (DNA) and ribonucleic acid (RNA)). The term nucleotide may include ribonucleoside triphosphates adenosine triphosphate (ATP), uridine triphosphate (UTP), cytosine triphosphate (CTP), guanosine triphosphate (GTP) and deoxyribonucleoside triphosphates such as dATP, dCTP, dITP, dUTP, dGTP, dTTP, or derivatives thereof. Such derivatives may include, for example, [αS]dATP, 7-deaza-dGTP and 7-deaza-dATP, and nucleotide derivatives that confer nuclease resistance on the nucleic acid molecule containing them. The term nucleotide as used herein may refer to dideoxyribonucleoside triphosphates (ddNTPs) and their derivatives. Illustrative examples of dideoxyribonucleoside triphosphates may include, but are not limited to, ddATP, ddCTP, ddGTP, ddITP, and ddTTP. A nucleotide may be unlabeled or detectably labeled, such as using moieties comprising optically detectable moieties (e.g., fluorophores). Labeling may also be carried out with quantum dots. Detectable labels may include, for example, radioactive isotopes, fluorescent labels, chemiluminescent labels, bioluminescent labels and enzyme labels. Fluorescent labels of nucleotides may include but are not limited fluorescein, 5-carboxyfluorescein (FAM), 2'7'-dimethoxy-4'5-dichloro-6-carboxyfluorescein (JOE), rhodamine, 6-carboxyrhodamine (R6G), N,N,N',N'-tetramethyl-6-carboxyrhodamine (TAMRA), 6-carboxy-X-rhodamine (ROX), 4-(4'dimethylaminophenylazo) benzoic acid (DABCYL), Cascade Blue, Oregon Green, Texas Red, Cyanine and 5-(2'-aminoethyl) aminonaphthalene-1-sulfonic acid (EDANS). Specific examples of fluorescently labeled nucleotides can include [R6G]dUTP, [TAMRA]dUTP, [R110]dCTP, [R6G]dCTP, [TAMRA]dCTP, [JOE]ddATP, [R6G]ddATP, [FAM]ddCTP, [R110]ddCTP, [TAMRA]ddGTP, [ROX]ddTTP, [dR6G] ddATP, [dR110]ddCTP, [dTAMRA]ddGTP, and [dROX] ddTTP available from Perkin Elmer, Foster City, Calif, FluoroLink DeoxyNucleotides, FluoroLink Cy3-dCTP, FluoroLink Cy5-dCTP, FluoroLink Fluor X-dCTP, FluoroLink Cy3-dUTP, and FluoroLink Cy5-dUTP available from Amersham, Arlington Heights, Ill.; Fluorescein-15-dATP, Fluorescein-12-dUTP, Tetramethyl-rodamine-6-dUTP, IR770-9-dATP, Fluorescein-12-ddUTP, Fluorescein-12-UTP, and Fluorescein-15-2'-dATP available from Boehringer Mannheim, Indianapolis, Ind.; and Chromosome Labeled Nucleotides, BODIPY-FL-14-UTP, BODIPY-FL-4-UTP, BODIPY-TMR-14-UTP, BODIPY-TMR-14-dUTP, BODIPY-TR-14-UTP, BODIPY-TR-14-dUTP, Cascade Blue-7-UTP, Cascade Blue-7-dUTP, fluorescein-12-UTP, fluorescein-12-dUTP, Oregon Green 488-5-dUTP, Rhodamine Green-5-UTP, Rhodamine Green-5-dUTP, tetramethylrhodamine-6-UTP, tetramethylrhodamine-6-dUTP, Texas Red-5-UTP, Texas Red-5-dUTP, and Texas Red-12-dUTP available from Molecular Probes, Eugene, Oreg. Nucleotides can also be labeled or marked by chemical modification. A chemically-modified single nucleotide can be biotin-dNTP. Some non-limiting examples of biotinylated dNTPs can include, biotin-dATP (e.g., bio-N6-ddATP, biotin-14-dATP), biotin-dCTP (e.g., biotin-11-dCTP, biotin-14-dCTP), and biotin-dUTP (e.g., biotin-11-dUTP, biotin-16-dUTP, biotin-20-dUTP).

The terms "polynucleotide," "oligonucleotide," and "nucleic acid" are used interchangeably to generally refer to a polymeric form of nucleotides of any length, either deoxyribonucleotides or ribonucleotides, or analogs thereof, either in single-, double-, or multi-stranded form. A polynucleotide may be exogenous or endogenous to a cell. A polynucleotide may exist in a cell-free environment. A polynucleotide may be a gene or fragment thereof. A polynucleotide may be DNA. A polynucleotide may be RNA. A polynucleotide may have any three-dimensional structure and may perform any function. A polynucleotide may comprise one or more analogs (e.g., altered backbone, sugar, or nucleobase). If present, modifications to the nucleotide structure may be imparted before or after assembly of the polymer. Some non-limiting examples of analogs include: 5-bromouracil, peptide nucleic acid, xeno nucleic acid, morpholinos, locked nucleic acids, glycol nucleic acids, threose nucleic acids, dideoxynucleotides, cordycepin, 7-deaza-GTP, fluorophores (e.g., rhodamine or fluorescein linked to the sugar), thiol containing nucleotides, biotin linked nucleotides, fluorescent base analogs, CpG islands, methyl-7-guanosine, methylated nucleotides, inosine, thiouridine, pseudouridine, dihydrouridine, queuosine, and wyosine. Non-limiting examples of polynucleotides include coding or non-coding regions of a gene or gene fragment, loci (locus) defined from linkage analysis, exons, introns, messenger RNA (mRNA), transfer RNA (tRNA), ribosomal RNA (rRNA), short interfering RNA (siRNA), short-hairpin RNA (shRNA), microRNA (miRNA), ribozymes, cDNA, recombinant polynucleotides, branched polynucleotides, plasmids, vectors, isolated DNA of any sequence, isolated RNA of any sequence, cell-free polynucleotides including cell-free DNA (cfDNA) and cell-free RNA (cfRNA), nucleic acid probes, and primers. The sequence of nucleotides may be interrupted by non-nucleotide components.

The terms "transfection" or "transfected" generally refer to introduction of a nucleic acid into a cell by non-viral or viral-based methods. The nucleic acid molecules may be gene sequences encoding complete proteins or functional portions thereof. See, e.g., Sambrook et al., 1989, Molecular Cloning: A Laboratory Manual, 18.1-18.88.

The terms "peptide," "polypeptide," and "protein" are used interchangeably herein to generally refer to a polymer of at least two amino acid residues joined by peptide bond(s). This term does not connote a specific length of polymer, nor is it intended to imply or distinguish whether the peptide is produced using recombinant techniques, chemical or enzymatic synthesis, or is naturally occurring. The terms apply to naturally occurring amino acid polymers as well as amino acid polymers comprising at least one modified amino acid. In some cases, the polymer may be interrupted by non-amino acids. The terms include amino acid chains of any length, including full length proteins, and proteins with or without secondary and/or tertiary structure (e.g., domains). The terms also encompass an amino acid polymer that has been modified, for example, by disulfide bond formation, glycosylation, lipidation, acetylation, phosphorylation, oxidation, and any other manipulation such as conjugation with a labeling component. The terms "amino acid" and "amino acids," as used herein, generally refer to natural and non-natural amino acids, including, but not limited to, modified amino acids and amino acid analogues. Modified amino acids may include natural amino acids and non-natural amino acids, which have been chemically modified to include a group or a chemical moiety not naturally present on the amino acid. Amino acid analogues may refer to amino acid derivatives. The term "amino acid" includes both D-amino acids and L-amino acids.

As used herein, the "non-native" can generally refer to a nucleic acid or polypeptide sequence that is not found in a native nucleic acid or protein. Non-native may refer to affinity tags. Non-native may refer to fusions. Non-native may refer to a naturally occurring nucleic acid or polypeptide sequence that comprises mutations, insertions and/or deletions. A non-native sequence may exhibit and/or encode for an activity (e.g., enzymatic activity, methyltransferase activity, acetyltransferase activity, kinase activity, ubiquitinating activity, etc.) that may also be exhibited by the nucleic acid and/or polypeptide sequence to which the non-native sequence is fused. A non-native nucleic acid or polypeptide sequence may be linked to a naturally-occurring nucleic acid or polypeptide sequence (or a variant thereof) by genetic engineering to generate a chimeric nucleic acid and/or polypeptide sequence encoding a chimeric nucleic acid and/or polypeptide.

The term "promoter", as used herein, generally refers to the regulatory DNA region which controls transcription or expression of a gene and which may be located adjacent to or overlapping a nucleotide or region of nucleotides at which RNA transcription is initiated. A promoter may contain specific DNA sequences which bind protein factors, often referred to as transcription factors, which facilitate binding of RNA polymerase to the DNA leading to gene transcription. A 'basal promoter', also referred to as a 'core promoter', may generally refer to a promoter that contains all the basic necessary elements to promote transcriptional expression of an operably linked polynucleotide. Eukaryotic basal promoters typically, though not necessarily, contain a TATA-box and/or a CAAT box.

The term "expression", as used herein, generally refers to the process by which a nucleic acid sequence or a polynucleotide is transcribed from a DNA template (such as into mRNA or other RNA transcript) and/or the process by which a transcribed mRNA is subsequently translated into peptides, polypeptides, or proteins. Transcripts and encoded polypeptides may be collectively referred to as "gene product." If the polynucleotide is derived from genomic DNA, expression may include splicing of the mRNA in a eukaryotic cell.

As used herein, "operably linked", "operable linkage", "operatively linked", or grammatical equivalents thereof generally refer to juxtaposition of genetic elements, e.g., a promoter, an enhancer, a polyadenylation sequence, etc., wherein the elements are in a relationship permitting them to operate in the expected manner. For instance, a regulatory element, which may comprise promoter and/or enhancer sequences, is operatively linked to a coding region if the regulatory element helps initiate transcription of the coding sequence. There may be intervening residues between the regulatory element and coding region so long as this functional relationship is maintained.

A "vector" as used herein, generally refers to a macromolecule or association of macromolecules that comprises or associates with a polynucleotide and which may be used to mediate delivery of the polynucleotide to a cell. Examples of vectors include plasmids, viral vectors, liposomes, and other gene delivery vehicles. The vector generally comprises genetic elements, e.g., regulatory elements, operatively linked to a gene to facilitate expression of the gene in a target.

As used herein, "an expression cassette" and "a nucleic acid cassette" are used interchangeably generally to refer to a combination of nucleic acid sequences or elements that are expressed together or are operably linked for expression. In some cases, an expression cassette refers to the combination of regulatory elements and a gene or genes to which they are operably linked for expression.

A "functional fragment" of a DNA or protein sequence generally refers to a fragment that retains a biological activity (either functional or structural) that is substantially similar to a biological activity of the full-length DNA or protein sequence. A biological activity of a DNA sequence may be its ability to influence expression in a manner known to be attributed to the full-length sequence.

As used herein, an "engineered" object generally indicates that the object has been modified by human intervention. According to non-limiting examples: a nucleic acid may be modified by changing its sequence to a sequence that does not occur in nature; a nucleic acid may be modified by ligating it to a nucleic acid that it does not associate with in nature such that the ligated product possesses a function not present in the original nucleic acid; an engineered nucleic acid may synthesized in vitro with a sequence that does not exist in nature; a protein may be modified by changing its amino acid sequence to a sequence that does not exist in nature; an engineered protein may acquire a new function or property. An "engineered" system comprises at least one engineered component.

As used herein, "synthetic" and "artificial" are used interchangeably to refer to a protein or a domain thereof that has low sequence identity (e.g., less than 50% sequence identity, less than 25% sequence identity, less than 10% sequence identity, less than 5% sequence identity, less than 1% sequence identity) to a naturally occurring human protein. For example, VPR and VP64 domains are synthetic transactivation domains.

The term "tracrRNA" or "tracr sequence", as used herein, can generally refer to a nucleic acid with at least about 5%, 10%, 20%, 30%, 40%, 50%, 60%, 70%, 80%, 90%, 95%, or 100% sequence identity and/or sequence similarity to a wild type exemplary tracrRNA sequence (e.g., a tracrRNA from S. pyogenes S. aureus, etc.). tracrRNA can refer to a nucleic acid with at most about 5%, 10%, 20%, 30%, 40%, 50%, 60%, 70%, 80%, 90%, or 100% sequence identity and/or sequence similarity to a wild type exemplary tracrRNA sequence (e.g., a tracrRNA from S. pyogenes S. aureus, etc.). tracrRNA may refer to a modified form of a tracrRNA that can comprise a nucleotide change such as a deletion, insertion, or substitution, variant, mutation, or chimera. A tracrRNA may refer to a nucleic acid that can be at least about 60% identical to a wild type exemplary tracrRNA (e.g., a tracrRNA from S. pyogenes S. aureus, etc.) sequence over a stretch of at least 6 contiguous nucleotides. For example, a tracrRNA sequence can be at least about 60% identical, at least about 65% identical, at least about 70% identical, at least about 75% identical, at least about 80% identical, at least about 85% identical, at least about 90% identical, at least about 95% identical, at least about 98% identical, at least about 99% identical, or 100% identical to a wild type exemplary tracrRNA (e.g., a tracrRNA from S. pyogenes S. aureus, etc.) sequence over a stretch of at least 6 contiguous nucleotides. Type II tracrRNA sequences can be predicted on a genome sequence by identifying regions with complementarity to part of the repeat sequence in an adjacent CRISPR array.

As used herein, a "guide nucleic acid" can generally refer to a nucleic acid that may hybridize to another nucleic acid. A guide nucleic acid may be RNA. A guide nucleic acid may be DNA. The guide nucleic acid may be programmed to bind to a sequence of nucleic acid site-specifically. The nucleic acid to be targeted, or the target nucleic acid, may comprise nucleotides. The guide nucleic acid may comprise nucleotides. A portion of the target nucleic acid may be complementary to a portion of the guide nucleic acid. The strand of a double-stranded target polynucleotide that is complementary to and hybridizes with the guide nucleic acid may be called the complementary strand. The strand of the double-stranded target polynucleotide that is complementary to the complementary strand, and therefore may not be complementary to the guide nucleic acid may be called noncomplementary strand. A guide nucleic acid may comprise a polynucleotide chain and can be called a "single guide nucleic acid." A guide nucleic acid may comprise two polynucleotide chains and may be called a "double guide nucleic acid." If not otherwise specified, the term "guide nucleic acid" may be inclusive, referring to both single guide nucleic acids and double guide nucleic acids. A guide nucleic acid may comprise a segment that can be referred to as a "nucleic acid-targeting segment" or a "nucleic acid-targeting sequence." A nucleic acid-targeting segment may comprise a sub-segment that may be referred to as a "protein binding segment" or "protein binding sequence" or "Cas protein binding segment".

The term "sequence identity" or "percent identity" in the context of two or more nucleic acids or polypeptide sequences, generally refers to two (e.g., in a pairwise alignment) or more (e.g., in a multiple sequence alignment) sequences that are the same or have a specified percentage of amino acid residues or nucleotides that are the same, when compared and aligned for maximum correspondence over a local or global comparison window, as measured using a sequence comparison algorithm. Suitable sequence comparison algorithms for polypeptide sequences include, e.g., BLASTP using parameters of a wordlength (W) of 3, an expectation (E) of 10, and the BLOSUM62 scoring matrix setting gap costs at existence of 11, extension of 1, and using a conditional compositional score matrix adjustment for polypeptide sequences longer than 30 residues; BLASTP using parameters of a wordlength (W) of 2, an expectation (E) of 1000000, and the PAM30 scoring matrix setting gap costs at 9 to open gaps and 1 to extend gaps for sequences of less than 30 residues (these are the default parameters for BLASTP in the BLAST suite available at blast.ncbi.nlm.nih.gov); CLUSTALW with parameters of; the Smith-Waterman homology search algorithm with parameters of a match of 2, a mismatch of −1, and a gap of −1; MUSCLE with default parameters; MAFFT with parameters retree of 2 and maxiterations of 1000; Novafold with default parameters; HMMER hmmalign with default parameters.

As used herein, the term "RuvC_III domain" generally refers to a third discontinuous segment of a RuvC endonuclease domain (the RuvC nuclease domain being comprised of three discontiguous segments, RuvC_I, RuvC_II, and RuvC_III). A RuvC domain or segments thereof can generally be identified by alignment to known domain sequences, structural alignment to proteins with annotated domains, or by comparison to Hidden Markov Models (HMMs) built based on known domain sequences (e.g., Pfam HMM PF18541 for RuvC_III).

As used herein, the term "HNH domain" generally refers to an endonuclease domain having characteristic histidine and asparagine residues. An HNH domain can generally be identified by alignment to known domain sequences, structural alignment to proteins with annotated domains, or by comparison to Hidden Markov Models (HMMs) built based on known domain sequences (e.g., Pfam HMM PF01844 for domain HNH).

As used herein, the term "base editor" generally refers to an enzyme that catalyzes the conversion of one target base or base pair into another (e.g. A:T to G:C, C:G to T:A) without requiring the creation and repair of a double-strand break. In some embodiments, the base editor is a deaminase.

As used herein, the term "deaminase" generally refers to a protein or enzyme that catalyzes a deamination reaction. In some embodiments, the deaminase is an adenosine deaminase, which catalyzes the hydrolytic deamination of adenine or adenosine (e.g., an engineered adenosine deaminase that deaminates adenosine in DNA). In some embodiments, the deaminase or deaminase domain is a cytidine (or cytosine) deaminase, catalyzing the hydrolytic deamination of cytidine (or cytosine) or deoxycytidine to uridine (or uracil) or deoxyuridine, respectively. In some embodiments, the deaminase or deaminase domain is a cytidine (or cytosine) deaminase domain, catalyzing the hydrolytic deamination of cytosine (or cytosine) to uracil (or uridine). In some embodiments, the deaminase or deaminase domain is a naturally-occurring deaminase from an organism, such as a human, chimpanzee, gorilla, monkey, cow, dog, rat, mouse, or bacterium (e.g. E. coli). In some embodiments, the deaminase or deaminase domain is a variant of a naturally-occurring deaminase from an organism that does not occur in nature.

The term "optimally aligned" in the context of two or more nucleic acids or polypeptide sequences, generally refers to two (e.g., in a pairwise alignment) or more (e.g., in a multiple sequence alignment) sequences that have been aligned to maximal correspondence of amino acids residues or nucleotides, for example, as determined by the alignment producing a highest or "optimized" percent identity score.

Included in the current disclosure are variants of any of the enzymes described herein with one or more conservative amino acid substitutions. Such conservative substitutions can be made in the amino acid sequence of a polypeptide without disrupting the three-dimensional structure or function of the polypeptide. Conservative substitutions can be accomplished by substituting amino acids with similar hydrophobicity, polarity, and R chain length for one another. Additionally, or alternatively, by comparing aligned sequences of homologous proteins from different species, conservative substitutions can be identified by locating amino acid residues that have been mutated between species (e.g., non-conserved residues) without altering the basic functions of the encoded proteins. Such conservatively substituted variants may include variants with at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99% identity to any one of the endonuclease protein sequences described herein. In some embodiments, such conservatively substituted variants are functional variants. Such functional variants can encompass sequences with substitutions such that the activity of one or more critical active site residues or guide RNA binding residues of the endonuclease are not disrupted.

Also included in the current disclosure are variants of any of the enzymes described herein with substitution of one or more catalytic residues to decrease or eliminate activity of the enzyme (e.g. decreased-activity variants). In some embodiments, a decreased activity variant as a protein described herein comprises a disrupting substitution of at least one, at least two, or all three catalytic residues. In some embodiments, any of the endonucleases described herein can comprise a nickase mutation. In some embodiments, any of the endonucleases described herein can comprise a RuvC domain lacking nuclease activity. In some embodiments, any of the endonucleases described herein can be configured to cleave one strand of a double-stranded target deoxyribonucleic acid. In some embodiments, any of the endonucleases described herein can comprise can be configured to lack endonuclease activity or be catalytically dead.

Conservative substitution tables providing functionally similar amino acids are available from a variety of references (see, for e.g., Creighton, Proteins: Structures and Molecular Properties (W H Freeman & Co.; 2nd edition (December 1993)). The following eight groups each contain amino acids that are conservative substitutions for one another:

1) Alanine (A), Glycine (G);
2) Aspartic acid (D), Glutamic acid (E);
3) Asparagine (N), Glutamine (Q);
4) Arginine (R), Lysine (K);
5) Isoleucine (I), Leucine (L), Methionine (M), Valine (V);
6) Phenylalanine (F), Tyrosine (Y), Tryptophan (W);
7) Serine (S), Threonine (T); and
8) Cysteine (C), Methionine (M)

Overview

The discovery of new Cas enzymes with unique functionality and structure may offer the potential to further disrupt deoxyribonucleic acid (DNA) editing technologies, improving speed, specificity, functionality, and ease of use. Relative to the predicted prevalence of Clustered Regularly Interspaced Short Palindromic Repeats (CRISPR) systems in microbes and the sheer diversity of microbial species, comparatively few functionally characterized CRISPR/Cas enzymes exist in the literature. This is partly because a huge number of microbial species may not be readily cultivated in laboratory conditions. Metagenomic sequencing from natural environmental niches that represent large numbers of microbial species may offer the potential to drastically increase the number of new CRISPR/Cas systems known and speed the discovery of new oligonucleotide editing functionalities. A recent example of the fruitfulness of such an approach is demonstrated by the 2016 discovery of CasX/CasY CRISPR systems from metagenomic analysis of natural microbial communities.

CRISPR/Cas systems are RNA-directed nuclease complexes that have been described to function as an adaptive immune system in microbes. In their natural context, CRISPR/Cas systems occur in CRISPR (clustered regularly interspaced short palindromic repeats) operons or loci, which generally comprise two parts: (i) an array of short repetitive sequences (30-40 bp) separated by equally short spacer sequences, which encode the RNA-based targeting element; and (ii) ORFs encoding the Cas encoding the nuclease polypeptide directed by the RNA-based targeting element alongside accessory proteins/enzymes. Efficient nuclease targeting of a particular target nucleic acid sequence generally requires both (i) complementary hybridization between the first 6-8 nucleic acids of the target (the target seed) and the crRNA guide; and (ii) the presence of a protospacer-adjacent motif (PAM) sequence within a defined vicinity of the target seed (the PAM usually being a sequence not commonly represented within the host genome). Depending on the exact function and organization of the system, CRISPR-Cas systems are commonly organized into 2 classes, 5 types and 16 subtypes based on shared functional characteristics and evolutionary similarity (see FIG. 1).

Class I CRISPR-Cas systems have large, multisubunit effector complexes, and comprise Types I, III, and IV.

Type I CRISPR-Cas systems are considered of moderate complexity in terms of components. In Type I CRISPR-Cas systems, the array of RNA-targeting elements is transcribed as a long precursor crRNA (pre-crRNA) that is processed at repeat elements to liberate short, mature crRNAs that direct the nuclease complex to nucleic acid targets when they are followed by a suitable short consensus sequence called a protospacer-adjacent motif (PAM). This processing occurs via an endoribonuclease subunit (Cas6) of a large endonuclease complex called Cascade, which also comprises a nuclease (Cas3) protein component of the crRNA-directed nuclease complex. Cas I nucleases function primarily as DNA nucleases.

Type III CRISPR systems may be characterized by the presence of a central nuclease, known as Cas10, alongside a repeat-associated mysterious protein (RAMP) that comprises Csm or Cmr protein subunits. Like in Type I systems, the mature crRNA is processed from a pre-crRNA using a Cas6-like enzyme. Unlike type I and II systems, type III systems appear to target and cleave DNA-RNA duplexes (such as DNA strands being used as templates for an RNA polymerase).

Type IV CRISPR-Cas systems possess an effector complex that consists of a highly reduced large subunit nuclease (csf1), two genes for RAMP proteins of the Cas5 (csf3) and Cas7 (csf2) groups, and, in some cases, a gene for a predicted small subunit; such systems are commonly found on endogenous plasmids.

Class II CRISPR-Cas systems generally have single-polypeptide multidomain nuclease effectors, and comprise Types II, V and VI.

Type II CRISPR-Cas systems are considered the simplest in terms of components. In Type II CRISPR-Cas systems, the processing of the CRISPR array into mature crRNAs does not require the presence of a special endonuclease subunit, but rather a small trans-encoded crRNA (tracrRNA) with a region complementary to the array repeat sequence; the tracrRNA interacts with both its corresponding effector nuclease (e.g. Cas9) and the repeat sequence to form a precursor dsRNA structure, which is cleaved by endogenous RNAse III to generate a mature effector enzyme loaded with both tracrRNA and crRNA. Cas II nucleases are known as DNA nucleases. Type 2 effectors generally exhibit a structure consisting of a RuvC-like endonuclease domain that adopts the RNase H fold with an unrelated HNH nuclease domain inserted within the folds of the RuvC-like nuclease domain. The RuvC-like domain is responsible for the cleavage of the target (e.g., crRNA complementary) DNA strand, while the HNH domain is responsible for cleavage of the displaced DNA strand.

Type V CRISPR-Cas systems are characterized by a nuclease effector (e.g. Cas12) structure similar to that of Type II effectors, comprising a RuvC-like domain. Similar to Type II, most (but not all) Type V CRISPR systems use a tracrRNA to process pre-crRNAs into mature crRNAs; however, unlike Type II systems which requires RNAse III to cleave the pre-crRNA into multiple crRNAs, type V systems are capable of using the effector nuclease itself to cleave pre-crRNAs. Like Type-II CRISPR-Cas systems, Type V CRISPR-Cas systems are again known as DNA nucleases. Unlike Type II CRISPR-Cas systems, some Type V enzymes (e.g., Cas12a) appear to have a robust single-stranded nonspecific deoxyribonuclease activity that is activated by the first crRNA directed cleavage of a double-stranded target sequence.

Type VI CRIPSR-Cas systems have RNA-guided RNA endonucleases. Instead of RuvC-like domains, the single polypeptide effector of Type VI systems (e.g. Cas13) comprises two HEPN ribonuclease domains. Differing from both Type II and V systems, Type VI systems also appear to not need a tracrRNA for processing of pre-crRNA into crRNA. Similar to type V systems, however, some Type VI systems (e.g., C2C2) appear to possess robust single-stranded non-specific nuclease (ribonuclease) activity activated by the first crRNA directed cleavage of a target RNA.

Because of their simpler architecture, Class II CRISPR-Cas have been most widely adopted for engineering and development as designer nuclease/genome editing applications.

One of the early adaptations of such a system for in vitro use can be found in Jinek et al. (Science. 2012 Aug. 17; 337(6096):816-21, which is entirely incorporated herein by reference). The Jinek study first described a system that involved (i) recombinantly-expressed, purified full-length Cas9 (e.g., a Class II, Type II Cas enzyme) isolated from *S. pyogenes* SF370, (ii) purified mature ~42 nt crRNA bearing a ~20 nt 5' sequence complementary to the target DNA sequence to be cleaved followed by a 3' tracr-binding sequence (the whole crRNA being in vitro transcribed from a synthetic DNA template carrying a T7 promoter sequence); (iii) purified tracrRNA in vitro transcribed from a synthetic DNA template carrying a T7 promoter sequence, and (iv) $Mg^{2+}$. Jinek later described an improved, engineered system wherein the crRNA of (ii) is joined to the 5' end of (iii) by a linker (e.g., GAAA) to form a single fused synthetic guide RNA (sgRNA) capable of directing Cas9 to a target by itself.

Mali et al. (Science. 2013 Feb. 15; 339(6121): 823-826.), which is entirely incorporated herein by reference, later adapted this system for use in mammalian cells by providing DNA vectors encoding (i) an ORF encoding codon-optimized Cas9 (e.g., a Class II, Type II Cas enzyme) under a suitable mammalian promoter with a C-terminal nuclear localization sequence (e.g., SV40 NLS) and a suitable polyadenylation signal (e.g., TK pA signal); and (ii) an ORF encoding an sgRNA (having a 5' sequence beginning with G followed by 20 nt of a complementary targeting nucleic acid sequence joined to a 3' tracr-binding sequence, a linker, and the tracrRNA sequence) under a suitable Polymerase III promoter (e.g., the U6 promoter).

Base Editing

Base editing is the conversion of one target base or base pair into another (e.g. A:T to G:C, C:G to T:A) without requiring the creation and repair of a double-strand break. The base editing may be achieved with the help of DNA and RNA base editors that allow the introduction of point mutations at specific sites, in either DNA or RNA. Generally, DNA base editors may comprise a fusion of a catalytically inactive nuclease and a catalytically active base-modification enzyme that acts only on single-stranded DNAs (ssDNAs). RNA base editors may comprise of similar, RNA-specific enzymes. Base editing may increase the efficiency of gene modification, while reducing the off-target and random mutations in the DNA.

DNA base editors are engineered ribonucleoprotein complexes that act as tools for single base substitution in cells and organism. They may be created by fusing an engineered base-modification enzyme and a catalytically deficient Cas variant that cannot cut dsDNA, but it is able to unfold the dsDNA in a protospacer adjacent motif (PAM) sequence-dependent manner, such that a guide RNA can find its complementary target to indicate a ssDNA scission site. The guide RNA anneals to the complementary DNA, displacing a fragment of ssDNA and directing the Cas 'scissors' to the base modification site. The cellular repair machinery will repair the nicked non-edited strand using information from the complementary edited template.

So far, two types of DNA editors, cytosine base (CBEs) and adenine base editors (ABEs) have been developed. They were shown to efficiently and precisely edit point mutations in DNA with minimal off-target DNA editing (see Nat Biotechnol. 2017; 35:435-437, Nat Biotechnol. 2017; 35:438-440 and Nat Biotechnol. 2017; 35:475-480, each of which is entirely incorporated herein by reference). However, recent findings indicate that off-target modifications are present in DNA, and that many off-target modifications are also introduced into RNA by DNA base editors.

MG Base Editors

In some aspects, the present disclosure provides for an engineered nucleic acid editing system, comprising: (a) an endonuclease comprising a RuvC domain and an HNH domain, wherein the endonuclease is derived from an uncultivated microorganism, wherein the endonuclease is a class 2, type II Cas endonuclease, and wherein the endonuclease is configured to be deficient in nuclease activity; (b) a base editor coupled to the endonuclease; and (c) an engineered guide ribonucleic acid structure configured to form a complex with the endonuclease comprising: (i) a guide ribonucleic acid sequence configured to hybridize to a target deoxyribonucleic acid sequence; and (ii) a ribonucleic acid sequence configured to bind to the endonuclease. In some embodiments, the endonuclease comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs:70-78 or 597 or a variant thereof. In some cases, the RuvC domain lacks nuclease activity. In some cases, the endonuclease comprises a nickase mutation. In some cases, the endonuclease is configured to cleave one strand of a double-stranded target deoxyribonucleic acid. In some cases the ribonucleic acid sequence configured to bind to the endonuclease comprises a tracr sequence.

In some aspects, the present disclosure provides for an engineered nucleic acid editing system comprising: (a) an endonuclease having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs:70-78 or 597 or a variant thereof, wherein the endonuclease is configured to be deficient in nuclease activity; a base editor coupled to the endonuclease; and an engineered guide ribonucleic acid structure configured to form a complex with the endonuclease comprising: (i) a guide ribonucleic acid sequence configured to hybridize to a target deoxyribonucleic acid sequence; and (ii) a ribonucleic acid sequence configured to bind to the endonuclease. In some cases the ribonucleic acid sequence configured to bind to the endonuclease comprises a tracr sequence. In some cases, the RuvC domain lacks nuclease activity. In some cases, the endonuclease comprises a nickase mutation. In some cases, the endonuclease is configured to cleave one strand of a double-stranded target deoxyribonucleic acid.

In some aspects, the present disclosure provides for an engineered nucleic acid editing system comprising: (a) an endonuclease configured to bind to a protospacer adjacent motif (PAM) sequence comprising any one of SEQ ID NOs: 360-368 or 598, wherein the endonuclease is a class 2, type II Cas endonuclease, and the endonuclease is configured to be deficient in nuclease activity.; and (b) a base editor coupled to the endonuclease; and (c) an engineered guide ribonucleic acid structure configured to form a complex with the endonuclease comprising: (i) a guide ribonucleic acid sequence configured to hybridize to a target deoxyribonucleic acid sequence; and (ii) a ribonucleic acid sequence configured to bind to the endonuclease. In some cases, the ribonucleic acid sequence configured to bind to the endonuclease comprises a tracr sequence. In some cases, the endonuclease comprises a nickase mutation. In some cases, the RuvC domain lacks nuclease activity. In some cases, the endonuclease is configured to cleave one strand of a double-stranded target deoxyribonucleic acid.

In some embodiments, the endonuclease is derived from an uncultivated microorganism. In some embodiments, the endonuclease has less than 80% identity to a Cas9 endonuclease. In some embodiments, the endonuclease further comprises an HNH domain. In some embodiments, the tracr ribonucleic acid sequence comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to about 60 to 90 consecutive nucleotides selected from any one of SEQ ID NOs: 88-96 or 488-489 or a variant thereof. In some embodiments, the tracr ribonucleic acid sequence comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity non-degenerate nucleotides of any one of SEQ ID NOs: 88-96 or 488-489 or a variant thereof.

In some aspects, the present disclosure provides an engineered nucleic acid editing system comprising, (a) an engineered guide ribonucleic acid structure comprising: (i) a guide ribonucleic acid sequence configured to hybridize to a target deoxyribonucleic acid sequence; and (ii) a tracr ribonucleic acid sequence configured to bind to an endonuclease, wherein the tracr ribonucleic acid sequence comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity non-degenerate nucleotides of any one of SEQ ID NOs: 88-96 or 488-489 or a variant thereof; and a class 2, type II Cas endonuclease configured to bind to the engineered guide ribonucleic acid.

In some embodiments, the endonuclease is configured to bind to a protospacer adjacent motif (PAM) sequence comprising any one of SEQ ID NOs: 360, 362, or 368. In some embodiments, the base editor comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs: 1-51, 57-66, 385-443, 444-475, or 594-595 or a variant thereof. In some embodiments, the base editor is an adenosine deaminase. In some embodiments, the adenosine deaminase comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to SEQ ID NOs: 50-51, 57, 385-443, 448-475, or 595 or a variant thereof. In some embodiments, the base editor is a cytosine deaminase. In some embodiments, the cytosine deaminase comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs: 1-49, 444-447, 594, or 58-66 or a variant thereof.

In some embodiments, the engineered nucleic acid editing system further comprises a uracil DNA glycosylase inhibitor. In some embodiments, the uracil DNA glycosylase inhibitor comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs: 52-56 or SEQ ID NO: 67 or a variant thereof.

In some embodiments, the engineered guide ribonucleic acid structure comprises at least two ribonucleic acid polynucleotides. In some embodiments, the engineered guide ribonucleic acid structure comprises one ribonucleic acid polynucleotide comprising the guide ribonucleic acid sequence and the tracr ribonucleic acid sequence. In some embodiments, the guide ribonucleic acid sequence is complementary to a prokaryotic, bacterial, archaeal, eukaryotic, fungal, plant, mammalian, or human genomic sequence. In some embodiments, the guide ribonucleic acid sequence is 15-24 nucleotides in length. In some embodiments, the endonuclease comprises one or more nuclear localization sequences (NLSs) proximal to an N- or C-terminus of the endonuclease.

The NLS can comprise any of the sequences in Table 1 below, or a combination thereof:

TABLE 1

Example NLS Sequences that can be used with Cas Effectors According to the Disclosure

| Source | NLS amino acid sequence | SEQ ID NO: |
| --- | --- | --- |
| SV40 | PKKKRKV | 369 |
| nucleoplasmin bipartite NLS | KRPAATKKAGQAKKKK | 370 |
| c-myc NLS | PAAKRVKLD | 371 |
| c-myc NLS | RQRRNELKRSP | 372 |
| hRNPA1 M9 NLS | NQSSNFGPMKGGNFGGRSSGPYGGGGQYFAKPRNQGGY | 373 |
| Importin-alpha IBB domain | RMRIZFKNKGKDTAELRRRRVEVSVELRKAKKDEQILKRRNV | 374 |
| Myoma T protein | VSRKRPRP | 375 |
| Myoma T protein | PPKKARED | 376 |
| p53 | PQPKKKPL | 377 |
| mouse c-abl IV | SALIKKKKMAP | 378 |
| influenza virus NS1 | DRLRR | 379 |
| influenza virus NS1 | PKQKKRK | 380 |
| Hepatitis virus delta antigen | RKLKKKIKKL | 381 |
| mouse Mx1 protein | REKKKFLKRR | 382 |
| human poly(ADP-ribose) polymerase | KRKGDEVDGVDEVAKKKSKK | 383 |
| steroid hormone receptor (human) glucocorticoid | RKCLQAGMNLEARKTKK | 384 |

In some embodiments, the endonuclease is covalently coupled directly to the base editor or covalently coupled to the base editor through a linker. In some embodiments, linkers joining any of the enzymes or domains described herein can comprise one or multiple copies of a sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to SGGSSGGSSGSETPGTSESATPESSGGSSGGS, SGSETPGTSESATPESA, GSGGS, SGSETPGTSESAT-PES, SGGSS, or GAAA, or any other linker sequence described herein. In some embodiments, a polypeptide comprises the endonuclease and the base editor. In some embodiments, the endonuclease is configured to cleave one strand of a double-stranded target deoxyribonucleic acid. In some embodiments, the endonuclease comprises a sequence having at least 80%, at least 81%, at least 82%, at least 83%, at least 84%, at least 85%, at least 86%, at least 87%, at least 88%, at least 89%, at least 90%, at least 91%, at least 92%, at least 93% at least 94% at least 95%, at least 96%, at least 97%, at least 98%, at least 99%, or 100% sequence identity to any one of SEQ ID NOs:70-78 or 597 or a variant thereof. In some embodiments, the system further comprises a source of $Mg^{2+}$.

In some embodiments, the endonuclease comprises a sequence at least 70%, at least 80%, or at least 90% identical to SEQ ID NO: 70 or a variant thereof; the guide RNA structure comprises a sequence at least 70%, at least 80%, or at least 90% identical to at least one of SEQ ID NO: 88; and the endonuclease is configured to bind to a PAM comprising SEQ ID NO: 360.

In some embodiments, the endonuclease comprises a sequence at least 70%, at least 80%, or at least 90% identical to SEQ ID NO: 71 or a variant thereof; the guide RNA structure comprises a sequence at least 70%, at least 80%, or at least 90% identical to at least one of SEQ ID NO: 89; and the endonuclease is configured to bind to a PAM comprising SEQ ID NO: 361.

In some embodiments, the endonuclease comprises a sequence at least 70%, at least 80%, or at least 90% identical to SEQ ID NO: 73 or a variant thereof; the guide RNA structure comprises a sequence at least 70%, at least 80%, or at least 90% identical to at least one of SEQ ID NO: 91; and the endonuclease is configured to bind to a PAM comprising SEQ ID NO: 363.

In some embodiments, the endonuclease comprises a sequence at least 70%, at least 80%, or at least 90% identical to SEQ ID NO: 75 or a variant thereof; the guide RNA structure comprises a sequence at least 70%, at least 80%, or at least 90% identical to at least one of SEQ ID NO: 93; and the endonuclease is configured to bind to a PAM comprising SEQ ID NO: 365.

In some embodiments, the endonuclease comprises a sequence at least 70%, at least 80%, or at least 90% identical to SEQ ID NO: 76 or a variant thereof; the guide RNA structure comprises a sequence at least 70%, at least 80%, or at least 90% identical to at least one of SEQ ID NO: 94; and the endonuclease is configured to bind to a PAM comprising SEQ ID NO: 366.

In some embodiments, the endonuclease comprises a sequence at least 70%, at least 80%, or at least 90% identical to SEQ ID NO: 77 or a variant thereof; the guide RNA structure comprises a sequence at least 70%, at least 80%, or at least 90% identical to at least one of SEQ ID NO: 95; and the endonuclease is configured to bind to a PAM comprising SEQ ID NO: 367.

In some embodiments, the endonuclease comprises a sequence at least 70%, at least 80%, or at least 90% identical to SEQ ID NO: 78 or a variant thereof; the guide RNA structure comprises a sequence at least 70%, at least 80%, or at least 90% identical to at least one of SEQ ID NO: 96; and the endonuclease is configured to bind to a PAM comprising SEQ ID NO: 368.

In some embodiments, the base editor comprises an adenosine deaminase. In some embodiments, the adenosine deaminase comprises SEQ ID NO: 57 or a variant thereof. In some embodiments, the base editor comprises a cytosine deaminase. In some embodiments, the cytosine deaminase comprises SEQ ID NO: 58 or a variant thereof. In some embodiments, the engineered nucleic acid editing system described herein further comprises a uracil DNA glycosylation inhibitor. In some embodiments, the uracil DNA glycosylation inhibitor comprises SEQ ID NO: 67 or a variant thereof.

In some embodiments, the sequence identity is determined by a BLASTP, CLUSTALW, MUSCLE, MAFFT, or Smith-Waterman homology search algorithm. In some embodiments, the sequence identity is determined by said BLASTP homology search algorithm using parameters of a wordlength (W) of 3, an expectation (E) of 10, and a BLOSUM62 scoring matrix setting gap costs at existence of 11, extension of 1, and using a conditional compositional score matrix adjustment.

In some aspects, the present disclosure provides a nucleic acid comprising an engineered nucleic acid sequence optimized for expression in an organism, wherein the nucleic acid encodes a class 2, type II Cas endonuclease coupled to a base editor, and wherein the endonuclease is derived from an uncultivated microorganism.

In some aspects, the present disclosure provides a nucleic acid comprising an engineered nucleic acid sequence optimized for expression in an organism, wherein the nucleic acid encodes an endonuclease having at least 70%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs:70-78 or 597 or a variant thereof coupled to a base editor. In some embodiments, the endonuclease comprises a sequence encoding one or more nuclear localization sequences (NLSs) proximal to an N- or C-terminus of said endonuclease. In some embodiments, the organism is prokaryotic, bacterial, eukaryotic, fungal, plant, mammalian, rodent, or human.

In some aspects, the present disclosure provides a vector comprising a nucleic acid sequence encoding a class 2, type II Cas endonuclease coupled to a base editor, wherein said endonuclease is derived from an uncultivated microorganism. In some embodiments, the vector comprises the nucleic acid described herein. In some embodiments, the vector further comprises a nucleic acid encoding an engineered guide ribonucleic acid structure configured to form a complex with the endonuclease comprising: a guide ribonucleic acid sequence configured to hybridize to a target deoxyribonucleic acid sequence; and a tracr ribonucleic acid sequence configured to binding to the endonuclease. In some embodiments, the vector is a plasmid, a minicircle, a CELiD, an adeno-associated virus (AAV) derived virion, or a lentivirus. In some aspects, the present disclosure provides a cell comprising the vector described herein. In some aspects, the present disclosure provides a method of manufacturing an endonuclease, comprising cultivating the cell described herein.

In some aspects, the present disclosure provides a method for modifying a double-stranded deoxyribonucleic acid polynucleotide comprising contacting the double-stranded deoxyribonucleic acid polynucleotide with a complex comprising: an endonuclease comprising a RuvC domain and an HNH domain, wherein the endonuclease is derived from an uncultivated microorganism, wherein the endonuclease is a class 2, type II Cas endonuclease, and wherein the RuvC domain lacks nuclease activity; a base editor coupled to the endonuclease; and an engineered guide ribonucleic acid structure configured to bind to the endonuclease and the double-stranded deoxyribonucleic acid polynucleotide; wherein the double-stranded deoxyribonucleic acid polynucleotide comprises a protospacer adjacent motif (PAM).

In some embodiments, the endonuclease comprising a RuvC domain and an HNH domain is covalently coupled directly to the base editor or covalently coupled to the base editor through a linker. In some embodiments, the endonuclease comprising a RuvC domain and an HNH domain comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs:70-78 or 597 or a variant thereof.

In some aspects, the present disclosure provides a method for modifying a double-stranded deoxyribonucleic acid polynucleotide, comprising contacting the double-stranded deoxyribonucleic acid polynucleotide with a complex comprising: a class 2, type II Cas endonuclease, a base editor coupled to the endonuclease, and an engineered guide ribonucleic acid structure configured to bind to the endonuclease and the double-stranded deoxyribonucleic acid polynucleotide; wherein the double-stranded deoxyribonucleic acid polynucleotide comprises a protospacer adjacent motif (PAM); and wherein the PAM comprises a sequence selected from the group consisting of SEQ ID NOs: 360-368 or 598 or a variant thereof.

In some embodiments, the class 2, type II Cas endonuclease is covalently coupled to the base editor or coupled to the base editor through a linker. In some embodiments, the base editor comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to a sequence selected from SEQ ID NOs: 1-51, 57-66, 385-443, 444-475, or 594-595 or a variant thereof. In some embodiments, the base editor comprises an adenosine deaminase; the double-stranded deoxyribonucleic acid polynucleotide comprises an adenine; and modifying the double-stranded deoxyribonucleic acid polypeptide comprises converting the adenine to guanine. In some embodiments, the adenosine deaminase comprises a sequence with at least 95% identity to SEQ ID NO: 57 or a variant thereof.

In some embodiments, the base editor comprises a cytosine deaminase; the double-stranded deoxyribonucleic acid polynucleotide comprises a cytosine; and modifying the double-stranded deoxyribonucleic acid polypeptide comprises converting the cytosine to uracil. In some embodiments, the cytosine deaminase comprises a sequence with at least 95% identity to SEQ ID NO: 58 or a variant thereof. In some embodiments, the cytosine deaminase comprises a sequence with at least 95% identity to any one of SEQ ID NOs: 59-66 or a variant thereof.

In some embodiments, the complex further comprises a uracil DNA glycosylase inhibitor. In some embodiments, the uracil DNA glycosylase inhibitor comprises a sequence with at least 70%, 80%, 90% or 95% identity to any one of SEQ ID NOs: 52-56 or SEQ ID NO: 67 or a variant thereof. In some embodiments, the double-stranded deoxyribonucleic acid polynucleotide comprises a first strand comprising a sequence complementary to a sequence of the engineered guide ribonucleic acid structure and a second strand comprising said PAM. In some embodiments, the PAM is directly adjacent to the 3' end of the sequence complementary to the sequence of the engineered guide ribonucleic acid structure.

In some embodiments, the class 2, type II Cas endonuclease is not a Cas9 endonuclease, a Cas14 endonuclease, a Cas12a endonuclease, a Cas12b endonuclease, a Cas 12c endonuclease, a Cas12d endonuclease, a Cas12e endonuclease, a Cas13a endonuclease, a Cas13b endonuclease, a Cas13c endonuclease, or a Cas 13d endonuclease. In some embodiments, the class 2, type II Cas endonuclease is derived from an uncultivated microorganism. In some embodiments, the double-stranded deoxyribonucleic acid polynucleotide is a eukaryotic, plant, fungal, mammalian, rodent, or human double-stranded deoxyribonucleic acid polynucleotide.

In some aspects, the present disclosure provides a method of modifying a target nucleic acid locus, said method comprising delivering to said target nucleic acid locus the engineered nucleic acid editing system described herein, wherein the endonuclease is configured to form a complex with the engineered guide ribonucleic acid structure, and wherein the complex is configured such that upon binding of the complex to the target nucleic acid locus, the complex modifies a nucleotide of the target nucleic acid locus.

In some embodiments, the engineered nucleic acid editing system comprises an adenosine deaminase, the nucleotide is an adenine, and modifying the target nucleic acid locus comprises converting the adenine to a guanine. In some embodiments, the engineered nucleic acid editing system comprises a cytidine deaminase and a uracil DNA glycosylase inhibitor, the nucleotide is a cytosine and modifying the target nucleic acid locus comprises converting the adenine to a uracil. In some embodiments, the target nucleic acid locus comprises genomic DNA, viral DNA, or bacterial DNA. In some embodiments, the target nucleic acid locus is in vitro. In some embodiments, the target nucleic acid locus is within a cell. In some embodiments, the cell is a prokaryotic cell, a bacterial cell, a eukaryotic cell, a fungal cell, a plant cell, an animal cell, a mammalian cell, a rodent cell, a primate cell, or a human cell. In some embodiments, the cell is within an animal.

In some embodiments, the cell is within a cochlea. In some embodiments, the cell is within an embryo. In some embodiments, the embryo is a two-cell embryo. In some embodiments, the embryo is a mouse embryo. In some embodiments, delivering the engineered nucleic acid editing system to the target nucleic acid locus comprises delivering the nucleic acid described herein or the vector described herein. In some embodiments, delivering the engineered nucleic acid editing system to the target nucleic acid locus comprises delivering a nucleic acid comprising an open reading frame encoding the endonuclease.

In some embodiments, the nucleic acid comprises a promoter to which the open reading frame encoding the endonuclease is operably linked. In some embodiments, delivering the engineered nucleic acid editing system to said target nucleic acid locus comprises delivering a capped mRNA containing the open reading frame encoding the endonuclease. In some embodiments, delivering the engineered nucleic acid editing system to the target nucleic acid locus comprises delivering a translated polypeptide. In some embodiments, delivering the engineered nucleic acid editing system to the target nucleic acid locus comprises delivering a deoxyribonucleic acid (DNA) encoding the engineered guide ribonucleic acid structure operably linked to a ribonucleic acid (RNA) pol III promoter.

In some aspects, the present disclosure provides an engineered nucleic acid editing polypeptide, comprising: an endonuclease comprising a RuvC domain and an HNH domain, wherein the endonuclease is derived from an uncultivated microorganism, wherein the endonuclease is a class 2, type II Cas endonuclease, and wherein the endonuclease is configured to be deficient in nuclease activity. In some embodiments, the endonuclease comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs:70-78 or 597 or a variant thereof.

In some aspects, the present disclosure provides an engineered nucleic acid editing polypeptide, comprising: an endonuclease having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs:70-78 or 597 or a variant thereof, wherein the endonuclease is configured to be deficient in nuclease activity; and a base editor coupled to the endonuclease.

In some aspects, the present disclosure provides an engineered nucleic acid editing polypeptide, comprising: an endonuclease configured to bind to a protospacer adjacent motif (PAM) sequence comprising any one of SEQ ID NOs: 360-368 or 598, wherein the endonuclease is a class 2, type II Cas endonuclease, and wherein the endonuclease is configured to be deficient in nuclease activity; and a base editor coupled to the endonuclease.

In some embodiments, the endonuclease is derived from an uncultivated microorganism. In some embodiments, the endonuclease has less than 80% identity to a Cas9 endonuclease. In some embodiments, the endonuclease further comprises an HNH domain. In some embodiments, the ribonucleic acid sequence configured to bind the endonuclease comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to about 60 to 90 consecutive nucleotides selected from any one of SEQ ID NOs: 88-96 or 488-489 or a variant thereof. In some embodiments, the ribonucleic acid sequence configured to bind the endonuclease comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to non-degenerate nucleotides of any one of SEQ ID NOs: 88-96 or 488-489 or a variant thereof. In some embodiments, the base editor comprises a sequence with at least 70%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs:70-78 or 597 or a variant thereof. In some embodiments, the base editor is an adenosine deaminase. In some embodiments, the adenosine deaminase comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs: 50-51, 57, 385-443, 448-475, or 595 or a variant thereof. In some embodiments, the base editor is a cytosine deaminase. In some embodiments, the cytosine deaminase comprises a sequence with at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to any one of SEQ ID NOs: 1-49, 444-447, 594, or 58-66 or a variant thereof.

Systems of the present disclosure may be used for various applications, such as, for example, nucleic acid editing (e.g., gene editing), binding to a nucleic acid molecule (e.g., sequence-specific binding). Such systems may be used, for example, for addressing (e.g., removing or replacing) a genetically inherited mutation that may cause a disease in a subject, inactivating a gene in order to ascertain its function in a cell, as a diagnostic tool to detect disease-causing genetic elements (e.g. via cleavage of reverse-transcribed viral RNA or an amplified DNA sequence encoding a disease-causing mutation), as deactivated enzymes in combination with a probe to target and detect a specific nucleotide sequence (e.g. sequence encoding antibiotic resistance int bacteria), to render viruses inactive or incapable of infecting host cells by targeting viral genomes, to add genes or amend metabolic pathways to engineer organisms to produce valuable small molecules, macromolecules, or secondary metabolites, to establish a gene drive element for evolutionary selection, to detect cell perturbations by foreign small molecules and nucleotides as a biosensor.

TABLE 2

Sequence Listing of Protein and Nucleic Acid Sequences Referred to Herein

| Category | SEQ ID NO: | Description | Type | Organism | Other Information | Sequence |
| --- | --- | --- | --- | --- | --- | --- |
| Cytosine Deaminase | 594 | CMP/dCMP-type deaminase domain-containing protein (uniprot | protein | Cebus imitator | unknown | MEASPASRPRPLMGPR TFTENFTNNPEVFGRH QTYLCYEVKCQGPDG TRDLMTEQRDFLCNQ ARNLLSGFDGRHAER CFLDRVPSWRLDPAQ TYRVTCFISWSPCFSC |

TABLE 2-continued

Sequence Listing of Protein and Nucleic Acid Sequences Referred to Herein

| Category | SEQ ID NO: | Description | Type | Organism | Other Information | Sequence |
|---|---|---|---|---|---|---|
| | | accession A0A2K5RDN7) | | | | AREVAEFLQENPHVN LRIFAARIYDCRPRYEE GLQMLQNAGAQVSIM TSEEFRHCWDTFVDH QGHPFQPWEGLDEHS QALSRRLQAILQGNR WMILSL |
| Adenosine Deaminase | 595 | TadA* (ABE8.17m) | protein | unknown | unknown | MSEVEFSHEYWMRHA LTLAKRARDEREVPV GAVLVLNNRVIGEGW NRAIGLHDPTAHAEIM ALRQGGLVMQNYRLI DATLYSTFEPCVMCA GAMIHSRIGRVVFGVR NAKTGAAGSLMDVLH YPGMNHRVEITEGILA DECAALLCYFFRMPR RVFNAQKKAQSSTD |
| MG34 active effectors | 596 | MG34-1 effector | protein | unknown | uncultivated organism | MERELVLGIDYGGKY TGLAVVDRRHNQVLY ANRLKMRDDVAGILK DRRKQRGIRRTAQTK KKRLRELKNYLKSIGY NESTATFETVYSLAHK RGYDYADMPEEKTSE EIEAMDVEERKQWEK EKQEWEETKRNSRHR KEVVKDVHKAMIEGR ATEEQIKRVERIFNKQ YRPKRFNNRILTKCKV EDCGVNTPLRKNVRD LLIENIVRFFPIEQSEKD NLKDAVLDKNRREEV KSFFRKHKTDEHIRKQ VYDIADNKLSGRTVFC KEHILEHTEHSKEERK VFRLAPSLKTKIENVL AVIKDEILPKFTVNKV VMESNNFDIAAKTQG KKRLAKEEYGKGPRE GKETRKEALLRETDG RCIYCGKSIDISNAHD DHIFPRKAGGLNIFAN LVACCAVCNENKKGR TPLESGISPKPEIIAFMK NDLKKKILEDARNINT VDFNKYMSHASIGWR YMRDRLRESAGNKKL PIERQSGIYTAYFRRW WGFKKERGNTLHHAL DAVILASRKGYSDDGL VDMTLKPKYNKGGEF DPEKHLPEPIEFKMDK GSRGSALHDRNPLSYK KGIITRRFMVTEIECGK EDDVISETYREKLKEA FKRFDTKKGKCLTDK EAKEAGFCIKKNELV MSLKCSIKGTGPGQMI RINNNVFKTNVHNVG VDVYLDEKGKKKAYE RKNPRLSKHFIEPPPQP NGRVSFTLKRRDMVT VEGEDAIYRIKKLGTS PTIEAVVGSDGKTRTV SATKLTKANSAE |
| nickase | 597 | MG34-1 (D10A) | protein | unknown | uncultivated organism | MERELVLGIAYGGKY TGLAVVDRRHNQVLY ANRLKMRDDVAGILK DRRKQRGIRRTAQTK KKRLRELKNYLKSIGY |

TABLE 2-continued

Sequence Listing of Protein and Nucleic Acid Sequences Referred to Herein

| Category | SEQ ID NO: | Description | Type | Organism | Other Information | Sequence |
|---|---|---|---|---|---|---|
| | | | | | | NESTATFETVYSLAHK RGYDYADMPEEKTSE EIEAMDVEERKQWEK EKQEWEETKRNSRHR KEVVKDVHKAMIEGR ATEEQIKRVERIFNKQ YRPKRFNNRILTKCKV EDCGVNTPLRKNVRD LLIENIVRFFPIEQSEKD NLKDAVLDKNRREEV KSFFRKHKTDEHIRKQ VYDIADNKLSGRTVFC KEHILEHTEHSKEERK VFRLAPSLKTKIENVL AVIKDEILPKFTVNKV VMESNNFDIAAKTQG KKRLAKEEYGKGPRE GKETRKEALLRETDG RCIYCGKSIDISNAHD DHIFPRKAGGLNIFAN LVACCAVCNENKKGR TPLESGISPKPEIIAFMK NDLKKKILEDARNINT VDFNKYMSHASIGWR YMRDRLRESAGNKKL PIERQSGIYTAYFRRW WGFKKERGNTLHHAL DAVILASRKGYSDDGL VDMTLKPKYNKGGEF DPEKHLPEPIEFKMDK GSRGSALHDRNPLSYK KGIITRRFMVTEIECGK EDDVISETYREKLKEA FKRFDTKKGKCLTDK EAKEAGFCIKKNELV MSLKCSIKGTGPGQMI RINNNVFKTNVHNVG VDVYLDEKGKKKAYE RKNPRLSKHFIEPPPQP NGRVSFTLKRRDMVT VEGEDAIYRIKKLGTS PTIEAVVGSDGKTRTV SATKLTKANSAE |
| PAM | 598 | MG34-1 PAM | nucleotide | unknown | unknown | NGG |

EXAMPLES

Example 1.—Plasmid Construction for Base Editors

To create base editing enzymes that utilize CRISPR functionality to target their base editing, Cas effector enzymes were fused in various configurations to the exemplary deaminases described herein. This process involved a first stage of constructing vectors suitable for generating the fusion enzymes. Two entry plasmid vectors, MGA, and MGC, were first constructed.

Figure 3:
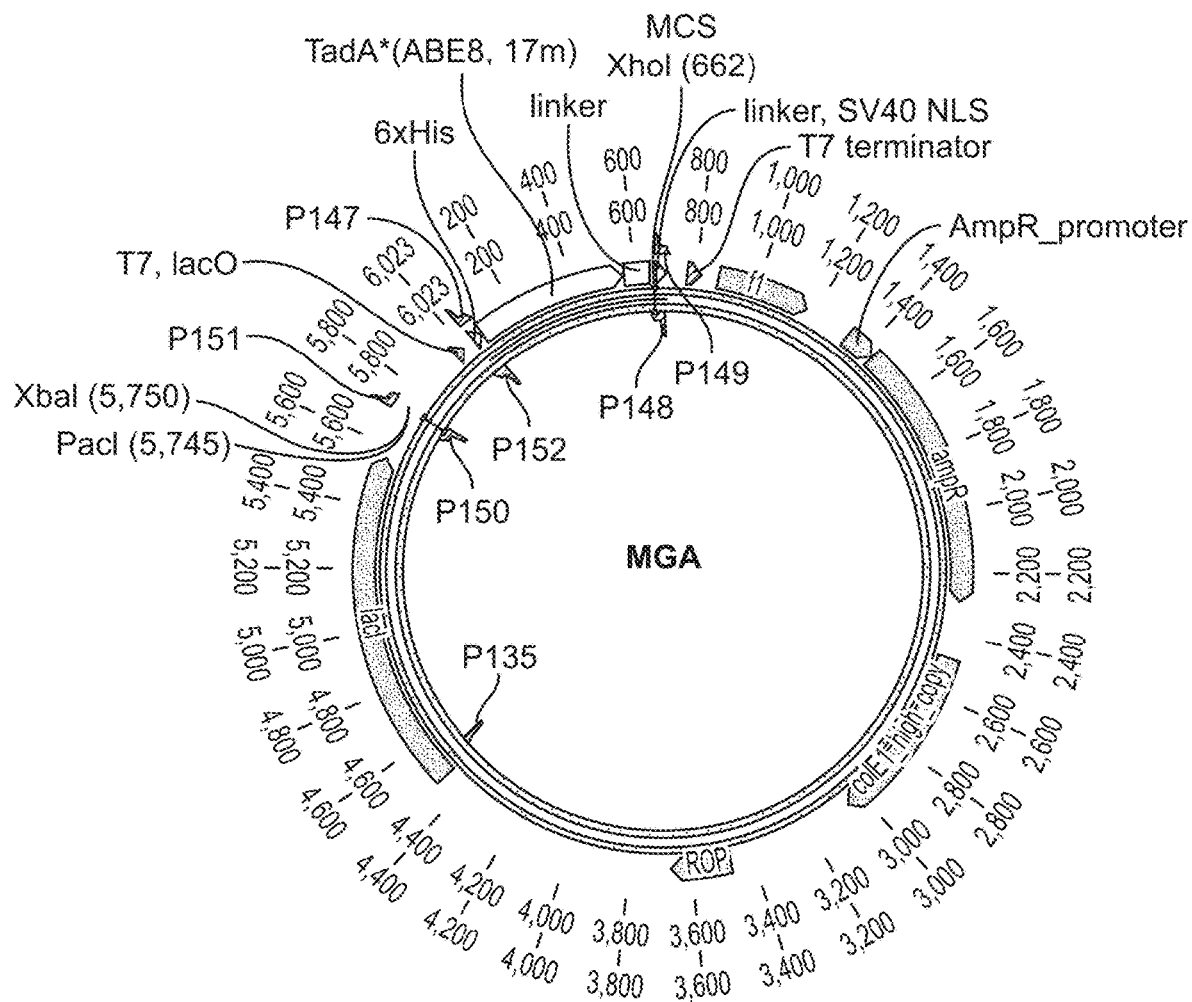
FIG. 3 shows plasmid maps for systems described herein. MGA contains TadA*(from ABE8.17m)-SV40 NLS and MGC contains APOBEC1 (from BE3) linked to a uracil glycosylase inhibitor and an SV40 NLS.
Figure 3:
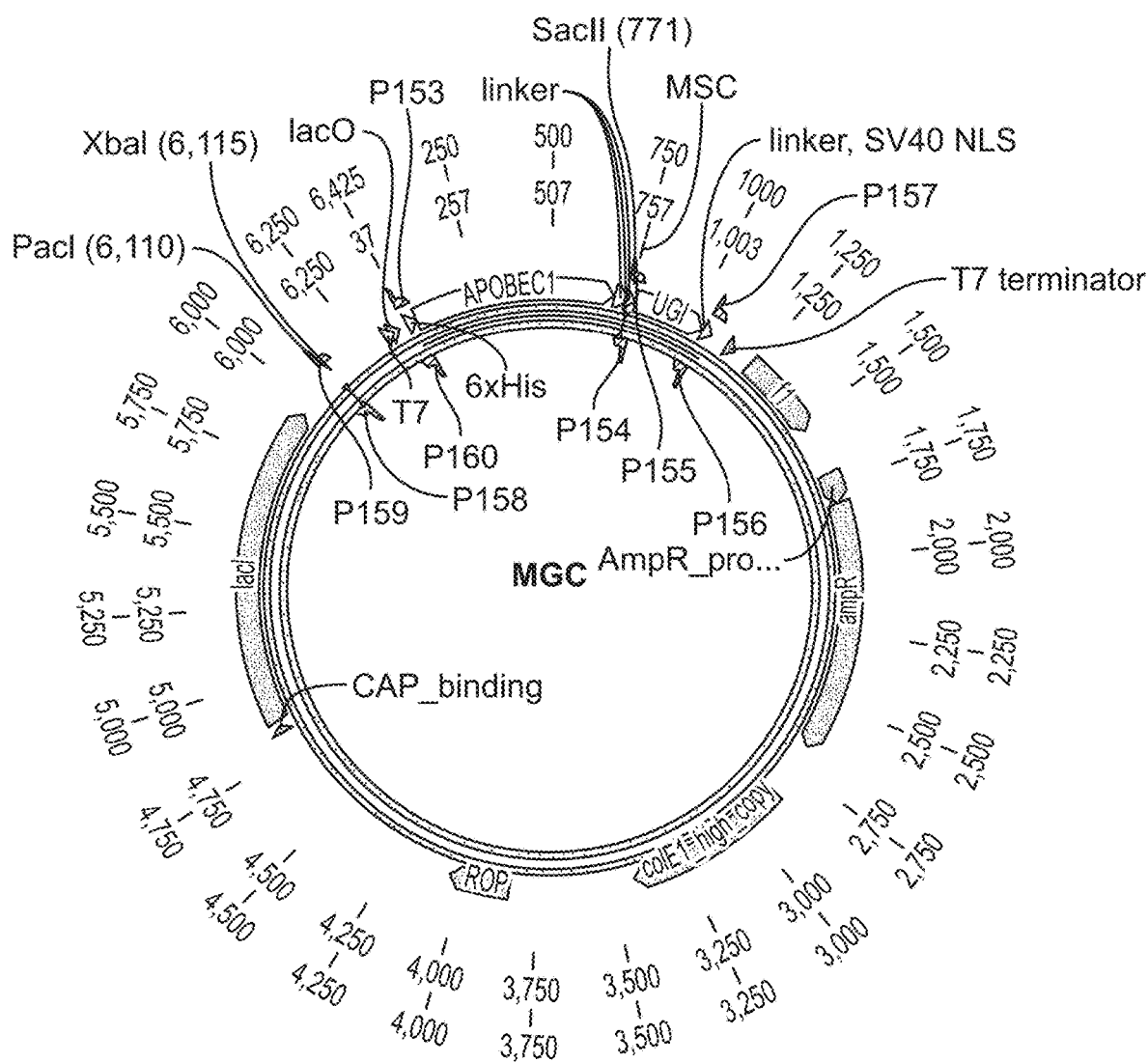

To construct the MGA (Metagenomi adenine base editor) entry plasmid containing T7 promoter-His tag-TadA* (ABE8.17m)-SV40 NLS, three DNA fragments were amplified from pAL6. To construct the MGC (Metagenomi cytosine base editor) entry plasmid containing T7 promoter-His tag-APOBEC1(BE3)-UGI-SV40 NLS, APOBEC1 and UGI-SV40 NLS were amplified from pAL9 and two pieces of vector backbones were amplified from pAL6 (see FIG. 3).

To introduce mutations into the effectors, source plasmids containing MG1-4, MG1-6, MG3-6, MG3-7, MG3-8, MG4-5, MG14-1, MG15-1, or MG18-1 effector gene sequences were amplified by Q5 DNA polymerase with forward primers incorporating appropriate mutations and reverse primers. The linear DNA fragments were then phosphorylated and ligated. The DNA templates were digested with DpnI using KLD Enzyme Mix (New England Biolabs) per the manufacturer's instructions.

Figure 2:
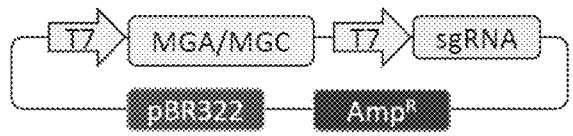
FIG. 2 shows the structure of a base editor plasmid containing a T7 promoter driving expression of the systems described herein.

To generate the pMGA and pMGC expression plasmids, genes were amplified from plasmids carrying mutated effectors and cloned into MGA and MGC entry plasmids via XhoI and SacII sites, respectively. To clone sgRNA expression cassettes comprising T7 promoter-sgRNA-bidirectional terminator into BE expression plasmids, one set of primers (P366 as the forward primer) was used to amplify a T7 promoter-spacer sequence while another set of primers (P367 as the reverse primer) was used to amplify spacer sequence-sgRNA scaffold-bidirectional terminator, in which pTCM plasmids were used as templates (see FIG. 2). The two fragments were assembled into pMGA and pMGC via XbaI sites, resulting pMGA-sgRNA and pMGC-sgRNA, respectively.

TABLE 3

Summary of constructs made for ABE screening systems described herein

| # | Application | Candidate |
|---|---|---|
| 1 | ABE | MGA1-4-sgRNA1 |
| 2 | | MGA1-4-sgRNA2 |
| 3 | | MGA1-4-sgRNA3 |
| 4 | | MGA1-6-sgRNA1 |
| 5 | | MGA1-6-sgRNA2 |
| 6 | | MGA1-6-sgRNA3 |
| 7 | | MGA3-6-sgRNA1 |
| 8 | | MGA3-6-sgRNA2 |
| 9 | | MGA3-6-sgRNA3 |
| 10 | | MGA3-7-sgRNA1 |
| 11 | | MGA3-7-sgRNA2 |
| 12 | | MGA3-7-sgRNA3 |
| 13 | | MGA3-8-sgRNA1 |
| 14 | | MGA3-8-sgRNA2 |
| 15 | | MGA3-8-sgRNA3 |
| 16 | | MGA14-1-sgRNA1 |
| 17 | | MGA14-1-sgRNA2 |
| 18 | | MGA14-1-sgRNA3 |
| 19 | | MGA15-1-sgRNA1 |
| 20 | | MGA15-1-sgRNA2 |
| 21 | | MGA15-1-sgRNA3 |
| 22 | | MGA18-1-sgRNA1 |
| 23 | | MGA18-1-sgRNA2 |
| 24 | | MGA18-1-sgRNA3 |
| 25 | | ABE8.17m-sgRNA1 |
| 26 | | ABE8.17m-sgRNA2 |
| 27 | | ABE8.17m-sgRNA3 |
| 28 | CBE | MGC1-4-sgRNA1 |
| 29 | | MGC1-4-sgRNA2 |
| 30 | | MGC1-4-sgRNA3 |
| 31 | | MGC1-6-sgRNA1 |
| 32 | | MGC1-6-sgRNA2 |
| 33 | | MGC1-6-sgRNA3 |
| 34 | | MGC3-6-sgRNA1 |
| 35 | | MGC3-6-sgRNA2 |
| 36 | | MGC3-6-sgRNA3 |
| 37 | | MGC3-7-sgRNA1 |
| 38 | | MGC3-7-sgRNA2 |
| 39 | | MGC3-7-sgRNA3 |
| 40 | | MGC3-8-sgRNA1 |
| 41 | | MGC3-8-sgRNA2 |
| 42 | | MGC3-8-sgRNA3 |
| 43 | | MGC4-5-sgRNA1 |
| 44 | | MGC4-5-sgRNA2 |
| 45 | | MGC4-5-sgRNA3 |
| 46 | | MGC14-1-sgRNA1 |
| 47 | | MGC14-1-sgRNA2 |
| 48 | | MGC14-1-sgRNA3 |
| 49 | | MGC15-1-sgRNA1 |
| 50 | | MGC15-1-sgRNA2 |
| 51 | | MGC15-1-sgRNA3 |
| 52 | | MGC18-1-sgRNA1 |
| 53 | | MGC18-1-sgRNA2 |
| 54 | | MGC18-1-sgRNA3 |
| 55 | | BE3-sgRNA1 |
| 56 | | BE3-sgRNA2 |
| 57 | | BE3-sgRNA3 |

Figures 4, 5:
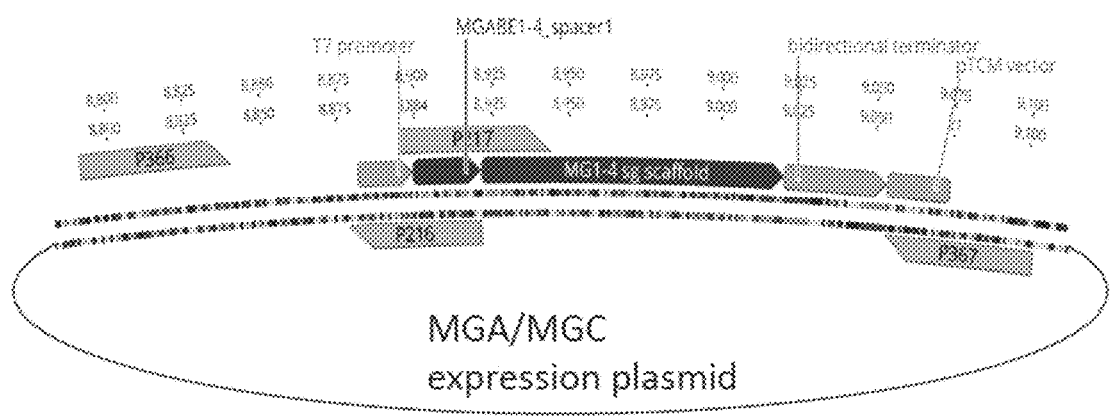
FIG. 4 shows predicted catalytic residues in the RuvCI domains of selected endonucleases described herein which are mutated to disrupt nuclease activity to generate nickase enzymes. Figure discloses SEQ ID NOS 601-612, respectively, in order of appearance.
FIG. 5 depicts an exemplary method for cloning a single guide RNA expression cassette into the systems described herein. One fragment comprises a T7 promoter plus spacer. The other fragment comprises spacer plus single guide scaffold sequence plus bidirectional terminator. The fragments are assembled into expression plasmids, resulting in functional constructs that can simultaneously express sgRNAs and base editors.

All amplified DNA fragments were purified by QIAquick Gel Extraction Kit (Qiagen), assembled via NEBuilder HiFi DNA Assembly (New England Biolabs), and the resulting assemblies were propagated via Endura Electrocompetent cells (Lucergen) per the manufacturer's instructions (see FIGS. 4 & 5). The DNA sequences of all cloned genes were confirmed at ELIM BIOPHARM.

TABLE 4

Conserved catalytic residues parsed out for selected systems described herein

| Nickase Candidate | Length | Associated Full-length Protein Sequence |
|---|---|---|
| nMG1-4 (D9A) | 1025 | SEQ ID NO: 70 |
| nMG1-6 (D13A) | 1059 | SEQ ID NO: 71 |
| nMG3-6 (D13A) | 1134 | SEQ ID NO: 72 |
| nMG3-7 (D12A) | 1131 | SEQ ID NO: 73 |
| nMG3-8 (D13A) | 1132 | SEQ ID NO: 74 |
| nMG4-5 (D17A) | 1055 | SEQ ID NO: 75 |
| nMG14-1 (D23A) | 1003 | SEQ ID NO: 76 |
| nMG15-1 (D8A) | 1082 | SEQ ID NO: 77 |
| nMG18-1 (D12A) | 1348 | SEQ ID NO: 78 |

Example 2.—Protein Expression and Purification

Figure 7:
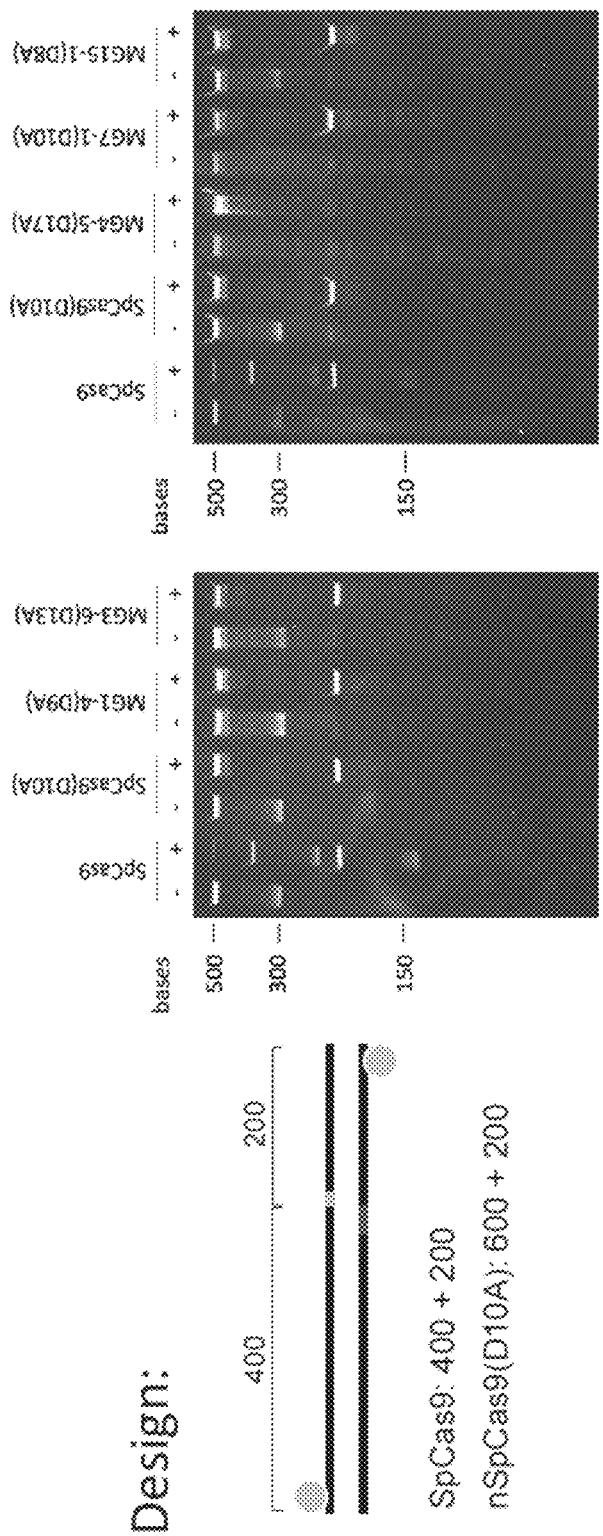
FIG. 7 shows the nickase activity of selected mutated effectors. 600 bp double-stranded DNA fragments labeled with a fluorophore (6-FAM) on both 5' ends were incubated with purified enzymes supplemented with their cognate sgRNAs. The reaction products were resolved on a 10% TBE-Urea denaturing gel. Double-stranded cleavage yields bands of 400 and 200 bases. Nickase activity yields bands of 600 and 200 bases.

The T7 promoter driven mutated effector genes in the pMGA and pMGC plasmids were expressed in *E. coli* BL21 (DE3) cells in Magic Media per manufacturer's instructions (Thermo) by transformation with each of the respective plasmids described in Example 1 above. After a 40 hour incubation at 16° C. the transformed cells were harvested, suspended in lysis buffer (HisTrap equilibration buffer: 20 mM Tris (Sigma T2319-100 ML), 300 mM sodium chloride (VWR VWRVE529-500 ML), 5% glycerol, 10 mM $MgCl_2$, with 10 mM imidazole (Sigma 68268-100 ML-F); pH 7.5) and EDTA-free protease inhibitor (Pierce), and frozen in the −80° C. freezer. The cells were then thawed on ice, sonicated, clarified, and filtered before affinity purification. The protein was applied to Cytiva 5 ml HisTrap FF column on the Akta Avant FPLC per the manufacturer's specifications and the protein was eluted in an isocratic elution of 20 mM Tris (Sigma T2319-100 ML), 300 mM sodium chloride (VWR VWRVE529-500 ML), 5% glycerol, 10 mM $MgCl_2$, with 250 mM imidazole (Sigma 68268-100 ML-F); pH 7.5. Eluted fractions containing the His-tagged effector proteins were concentrated and buffer exchanged into 50 mM Tris-HCl, 300 mM NaCl, 1 mM TCEP, 5% glycerol; pH 7.5. The protein concentration was determined by bicinchoninic acid assay (Thermo) and adjusted after determining the relative purity by SDS PAGE densitometry in Image Lab (Bio-Rad) (see FIG. 7).

Example 3.—In Vitro Nickase Assay 6-carboxyfluorescein (6-FAM) labeled primers P141 and P146 (SEQ ID NOs: 179 and 180) synthesized by IDT were used to amplify linear fragments of LacZ containing targeting sequences of effectors using Q5 DNA polymerase. DNA fragments containing the T7 promoter followed by sgRNAs containing 20-bp or 22-bp spacer sequences were transcribed in vitro using HiScribe T7 High Yield RNA Synthesis Kit (New England Biolabs) per manufacturer's instructions. Synthetic sgRNAs with the sequences corresponding to the named sgRNAs in the sequence listing were purified by Monarch RNA Cleanup Kit (New England Biolabs) according to the users manual and concentrations were measured by Nanodrop.

To determine DNA nickase activity, each of the purified mutated effectors was first supplemented with its cognate sgRNA. Reactions were initiated by adding the linear DNA substrate in a 15 µL reaction mixture containing 10 mM Tris pH 7.5, 10 mM MgCl$_2$, and 100 mM NaCl, 150 nM enzyme, 150 nM RNA, and 15 nM DNA. The reaction was incubated at 37° C. for 2h. Digested DNA was purified using AMPure XP SPRI paramagnetic beads (Beckman Coulter) and eluted with 6 µL TE buffer (10 mM Tris, 1 mM EDTA; pH 8.0). The nicked DNA was resolved on a 10% TBE-Urea denaturing gel (Biorad) and imaged by ChemiDoc (Bio-Rad) (see FIG. 7, which shows that the depicted enzymes display nickase activity by production of bands 600 and 200 bases versus 400 and 200 bases in the case of the wild-type enzyme). The results indicated that all the tested nickase mutants in FIG. 7 displayed their expected nickase activity instead of wild type cleavage activity with the exception of MG4-5 (D17A), which was inconclusive.

Example 4.—Base Editor Introduction into *E. coli*

Plasmids were transformed into Lucergen's electrocompetent BL21(DE3) cells according to the manufacturer's instructions. After electroporation, cells were recovered with expression recovery media at 37° C. for 1 h and spread on LB plates containing 100 L/mg ampicillin and 0.1 mM IPTG. After overnight growth at 37° C., colonies were picked and lacZ gene was amplified by Q5 DNA polymerase (New England Biolabs) with primers P137 and P360. The resulting PCR products were purified and sequenced by Sanger sequencing at ELIM BIOPHARM. Base edits were determined by examining whether there exists C to T conversion or A to G conversion in the targeted protospacer regions for cytosine base editors or adenine base editors, respectively.

To evaluate editing efficiency in *E. coli*, plasmids were transformed into electrocompetent BL21(DE3) (Lucergen) and the electroporated cells were recovered with expression recovery media at 37° C. for 1 h. 10 µL of recovered cells were then inoculated into 990 µL SOB containing 100 µL/mg ampicillin and 0.1 mM IPTG in a 96-well deep well plate, and grown at 37° C. for 20h. 1 µL cells induced for base editor expression were used for amplification of the lacZ gene in a 20 µL PCR reaction (Q5 DNA polymerase) with primers P137 and P360. The resulting PCR products were purified and sequenced by Sanger sequencing at ELIM BIOPHARM. Quantification of editing efficiency was processed by Edit R as described in Example 12.

TABLE 5

The MG base editors described herein with associated PAM and deaminases

| Candidate | Type | PAM | Deaminase | Linker (Deaminase-Nickase) | Nickase | UGI | Linker (Nickase-UGI) |
|---|---|---|---|---|---|---|---|
| MGA1-4 | II | nRRR SEQ ID NO: 360 | TadA* (ABE8.17m) SEQ ID NO: 595 | SGGSSGGSSGSE TPGTSESATPESS GGSSGGS | nMG1-4 (D9A) SEQ ID NO: 70 | — | |
| MGA3-7 | II | nnRnYAY SEQ ID NO: 363 | TadA* (ABE8.17m) SEQ ID NO: 595 | SGGSSGGSSGSE TPGTSESATPESS GGSSGGS | nMG3-7 (D12A) SEQ ID NO: 73 | — | |
| MGA18-1 | II | nRWART SEQ ID NO: 368 | TadA* (ABE8.17m) SEQ ID NO: 595 | SGGSSGGSSGSE TPGTSESATPESS GGSSGGS | nMG18-1 (D12A) SEQ ID NO: 78 | — | |
| MGC1-6 | II | nnRRAY SEQ ID NO: 361 | APOBEC1 (BE3) SEQ ID NO: 58 | SGSETPGTSESAT PESA | nMG1-6 (D13A) SEQ ID NO: 71 | UGI(BE3) SEQ ID NO: 67 | GSGGS |
| MGC3-7 | II | nnRnYAY SEQ ID NO: 363 | APOBEC1 (BE3) SEQ ID NO: 58 | SGSETPGTSESAT PESA | nMG3-7 (D12A) SEQ ID NO: 73 | UGI(BE3) SEQ ID NO: 67 | GSGGS |
| MGC4-5 | II | nRCCV SEQ ID NO: 365 | APOBEC1 (BE3) SEQ ID NO: 58 | SGSETPGTSESAT PESA | nMG4-5 (D17A) SEQ ID NO: 74 | UGI(BE3) SEQ ID NO: 67 | GSGGS |
| MGC14-1 | II | nRnnGRKA SEQ ID NO: 366 | APOBEC1 (BE3) SEQ ID NO: 58 | SGSETPGTSESAT PESA | nMG14-1 (D23A) SEQ ID NO: 76 | UGI(BE3) SEQ ID NO: 67 | GSGGS |
| MGC15-1 | II | nnnnC SEQ ID NO: 367 | APOBEC1 (BE3) SEQ ID NO: 58 | SGSETPGTSESAT PESA | nMG15-1 (D8A) SEQ ID NO: 77 | UGI(BE3) SEQ ID NO: 67 | GSGGS |
| MGC18-1 | II | nRWART SEQ ID NO 368 | APOBEC1 (BE3) SEQ ID NO: 58 | SGSETPGTSESAT PESA | nMG18-1 (D12A) SEQ ID NO: 78 | UGI(BE3) SEQ ID NO: 67 | GSGGS |

Example 5.—Protein Nucleofection and Amplicon Seq in Mammalian Cells (Prophetic)

Nucleofection is conducted in mammalian cells (e.g. K-562, Neuro-2A or RAW264.7) according to the manufacturer's recommendations using a Lonza 4D nucleofector and the Lonza SF Cell Line 4D-Nucleofector X Kit S (cat. no.

V4XC-2032). After formulating the SF nucleofection buffer, 200,000 cells are resuspended in 5 µl of buffer per nucleofection. In the remaining 15 µl of buffer per nucleofection, 20 pmol of chemically modified sgRNA from Synthego is combined with 18 pmol of base editor enzymes (e.g. ABE8e) and incubated for 5 min at room temperature to complex. Cells are added to the 20 µl nucleofection cuvettes, followed by protein solution, and the mixture is triturated to mix. Cells are nucleofected with program CM-130, immediately after which 80 µl of warmed media is added to each well for recovery. After 5 min, 25 µl from each sample is added to 250 µl of fresh media in a 48-well poly-d-lysine plate (Corning). Cells are then treated in the same way as lipofected cells above for genomic DNA extraction after three more days of culture.

Following Illumina barcoding, PCR products are pooled and purified by electrophoresis with a 2% agarose gel using a Monarch DNA Gel Extraction Kit (New England Biolabs), eluting with 30 µl H2O. DNA concentration is quantified with a Qubit dsDNA High Sensitivity Assay Kit (Thermo Fisher Scientific) and sequenced on an Illumina MiSeq instrument (paired-end read, R1: 250-280 cycles, R2: 0 cycles) according to the manufacturer's protocols.

Sequencing reads are demultiplexed using the MiSeq Reporter (Illumina) and FASTQ files are analyzed using CRISPResso2. Dual editing in individual alleles is analyzed by a Python script. Base editing values are representative of n=3 independent biological replicates collected by different researchers, with the mean±s.d. shown. Base editing values are reported as a percentage of the number of reads with adenine mutagenesis over the total aligned reads.

Example 6.—Plasmid Nucleofection and Whole Genome Seq in Mammalian Cells (Prophetic)

All plasmids are assembled by the uracil-specific excision reagent (USER) cloning method. Guide RNA plasmids for SpCas9, SaCas9 and all engineered variants are assembled. Plasmids for mammalian cell transfections are prepared using the ZymoPURE Plasmid Midiprep kit (Zymo Research Corporation). HEK293T cells (ATCC CRL-3216) are cultured in Dulbecco's modified Eagle's medium (Corning) supplemented with 10% fetal bovine serum (ThermoFisher Scientific) and maintained at 37° C. with 5% CO2.

HEK293T cells are seeded on 48-well poly-d-lysine plates (Corning) in the same culture medium. Cells are transfected 12-16 h after plating with 1.5 µl Lipofectamine 2000 (ThermoFisher Scientific) using 750 ng base editor plasmid, 250 ng guide RNA plasmid and 10 ng green fluorescent protein as a transfection control. Cells are cultured for 3 d with media exchanged following the first day, then washed with Å~1 PBS (ThermoFisher Scientific), followed by genomic DNA extraction by addition of 100 µl freshly prepared lysis buffer (10 mM Tris-HCl, pH 7.5, 0.05% SDS, 25 µg ml−1 proteinase K (ThermoFisher Scientific)) directly into each transfected well. The mixture is incubated at 37° C. for 1 h then heat inactivated at 80° C. for 30 min. Genomic DNA lysate is subsequently used immediately for high-throughput sequencing (HTS).

HTS of genomic DNA from HEK293T cells is performed. Following Illumina barcoding, PCR products are pooled and purified by electrophoresis with a 2% agarose gel using a Monarch DNA Gel Extraction Kit (NEB), eluting with 30 µl H2O. DNA concentration is quantified with Qubit dsDNA High Sensitivity Assay Kit (ThermoFisher Scientific) and sequenced on an Illumina MiSeq instrument (paired end read, R1: 250-280 cycles, R2: 0 cycles) according to the manufacturer's protocols.

Example 7.—Determining Editing Window (Prophetic)

To examine the editing window regions, the cytosine showing the highest C-T conversion frequency in a specified sgRNA is normalized to 1, and other cytosines at positions spanning from 30 nt upstream to 10 nt downstream of the PAM sequence (total 43 bp) of the same sgRNA are normalized subsequently. Then normalized C-T conversion frequencies are classified and compared according to their positions for all tested sgRNAs of a specified base editor. A comprehensive editing window (CEW) is defined to span positions with an average C-T conversion efficiency exceeding 0.6 after normalization.

To examine the substrate preference for each cytidine deaminase, C sites are initially classified according to their positions in sgRNA targeting regions and those positions containing at least one C site with ≥0.8 normalized C-T conversion frequency are included in subsequent analysis. Selected C sites are then compared depending on base types upstream or downstream of the edited cytosine (NC or CN). For cytidine deaminases showing efficient C-T conversion at both N-terminus and C-terminus of the endonuclease, the substrate preference is evaluated by integrating respective NT- and CT-CBEs together. For statistical analysis, one-way ANOVA is used and $p<0.05$ is considered as significant Example 8a.—Testing Off-Target Analysis with Whole Genome Sequencing and Transcriptomics in Mammalian Cells (Prophetic)

HEK293T cells are plated on 48-well poly-d-lysine-coated plates 16 to 20 h before lipofection at a density of 3.104 cells per well in DMEM+GlutaMAX medium (Thermo Fisher Scientific) without antibiotics. 750 ng nickase or base editor expression plasmid DNA is combined with 250 ng of sgRNA expression plasmid DNA in 15 µl Opti-MEM+GlutaMAX. This is combined with 10 µl of lipid mixture, comprising 1.5 µl Lipofectamine 2000 and 8.5 µl Opti-MEM+GlutaMAX per well. Cells are harvested 3 d after transfection and either DNA or RNA was harvested. For DNA analysis, cells are washed once in PBS, and then lysed in 100 µl QuickExtract Buffer (Lucigen) according to the manufacturer's instructions. For RNA harvest, the MagMAX mirVana Total RNA Isolation Kit (Thermo Fisher Scientific) is used with the KingFisher Flex.

Genomic DNA from mammalian cells is fragmented and adapter-ligated using the Nextera DNA Flex Library Prep Kit (Illumina) using 96-well plate Nextera indexing primers (Illumina), according to the manufacturer's instructions. Library size and concentration is confirmed by Fragment Analyzer (Agilent) and DNA is sent to Novogene for WGS using an Illumina HiSeq system.

All targeted NGS data is analyzed by performing four general steps: (1) alignment; (2) duplicate marking; (3) variant calling; and (4) background filtration of variants to remove artifacts and germline mutations. The mutation reference and alternate alleles are reported relative to the plus strand of the reference genome.

For whole Transcriptome sequencing, mRNA selection is performed using the NEBNext Poly(A) mRNA Magnetic Isolation Module (New England BioLabs). RNA library preparation is performed using NEBNext Ultra II RNA Library Prep Kit for Illumina (New England BioLabs). Based on the RNA input amount, a cycle number of 12 is used for the PCR enrichment of adapter-ligated DNA. NEBNext Sample Purification Beads (New England BioLabs) is used throughout for all of the size selection performed by this method. NEBNext Multiplex Oligos for Illumina (New England BioLabs) is used for the multiplex indexes in accordance with the PCR recipe outlined in the protocol. Prior to sequencing, samples are quality checked using the High Sensitivity D1000 ScreenTape on the 4200 TapeStation System (Agilent). The libraries are pooled and sequenced using a NovaSeq (Novogene). Targeted RNA sequencing is then performed. Complementary DNA is generated by PCR with reverse transcription (RT-PCR) from the isolated RNA using the SuperScript IV One-Step RT-PCR System with EZDnase (Thermo Fisher Scientific) according to the manufacturer's instructions.

The following program is used: 58° C. for 12 min; 98° C. for 2 min; followed by PCR cycles that varied by amplicon: for CTNNB1 and IP90; 32 cycles of (98° C. for 10 s; 60° C. for 10 sec; 72° C. for 30 sec). Following the combined RT-PCR, amplicons are barcoded and sequenced using an Illumina MiSeq sequencer as described above. The first 125 nucleotides in each amplicon, beginning at the first base after the end of the forward primer in each amplicon, are aligned to a reference sequence and used for analysis of maximum A-to-I frequencies in each amplicon. Off-target DNA sequencing is performed using primers, using a two-step PCR and barcoding method to prepare samples for sequencing using Illumina MiSeq sequencers as above.

Example 8b.—Analysis of Off-Target Edits by Whole Genome Sequencing and Transcriptomics (Prophetic)

Transfected cells prepared as in Example 8a are harvested after 3 days and the genomic DNA isolated using the Agencourt DNAdvance Genomic DNA Isolation Kit (Beckman Coulter) according to the manufacturer's instructions. On-target and off-target genomic regions of interest are amplified by PCR with flanking HTS primer pairs. PCR amplification is carried out with Phusion high-fidelity DNA polymerase (ThermoFisher) according to the manufacturer's instructions using 5 ng of genomic DNA as a template. Cycle numbers are determined separately for each primer pair as to ensure the reaction was stopped in the linear range of amplification (30, 28, 28, 28, 32, and 32 cycles for EMX1, FANCF, HEK293 site 2, HEK293 site 3, HEK293 site 4, and RNF2 primers, respectively). PCR products are purified using RapidTips (Diffinity Genomics). Purified DNA is amplified by PCR with primers containing sequencing adaptors. The products are gel-purified and quantified using the Quant-iT™ PicoGreen dsDNA Assay Kit (ThermoFisher) and KAPA Library Quantification Kit-Illumina (KAPA Biosystems). Samples are sequenced on an Illumina MiSeq as previously described.

Sequencing reads are automatically demultiplexed using MiSeq Reporter (Illumina), and individual FASTQ files are analyzed with a custom Matlab script. Each read is pairwise aligned to the appropriate reference sequence using the Smith-Waterman algorithm. Base calls with a Q-score below 31 are replaced with N's and are thus excluded in calculating nucleotide frequencies. This treatment yields an expected MiSeq base-calling error rate of approximately 1 in 1,000. Aligned sequences in which the read and reference sequence contained no gaps are stored in an alignment table from which base frequencies were tabulated for each locus. Indel frequencies were quantified with a custom Matlab script.

Sequencing reads are scanned for exact matches to two 10-bp sequences that flank both sides of a window in which indels might occur. If no exact matches were located, the read is excluded from analysis. If the length of this indel window exactly matched the reference sequence the read is classified as not containing an indel. If the indel window is two or more bases longer or shorter than the reference sequence, then the sequencing read is classified as an insertion or deletion, respectively.

Example 9.—Mouse Editing Experiments (Prophetic)

It is envisaged that a base editor consisting of a novel DNA targeting nuclease domain fused to a novel deaminase domain can be validated as a therapeutic candidate by testing in appropriate mouse models of disease.

One example of an appropriate model comprises mice that have been engineered to express the human PCSK9 protein, for example, as described by Herbert et al (10.1161/ATVBAHA.110.204040). The PCSK9 protein regulates LDL receptor (LDLR) levels and influences serum cholesterol levels. Mice expressing the human PCSK9 protein exhibit elevated levels of cholesterol and more rapid development of atherosclerosis. PCSK9 is a validated drug target for the reduction of lipid levels in people at increased risk of cardiovascular disease due abnormally high plasma lipid levels (doi.org/10.1038/s41569-018-0107-8). Reducing the levels of PCSK9 via genome editing is expected to permanently lower lipid levels for the life-time of the individual thus providing a life-long reduction in cardiovascular disease risk. One genome editing approach can involve targeting the coding sequence of the PCSK9 gene with the goal of editing a sequence to create a premature stop codon and thus prevent the translation of the PCSK9 mRNA into a functional protein. Targeting a region close to the 5' end of the coding sequence is useful in order to block translation of the majority of the protein. To create a stop codon (TGA, TAA, TAG) with high efficiency and specificity will require targeting a region of the PCSK9 coding sequence wherein the editing window will be placed over an appropriate sequence such that the highest frequency editing event results in a stop codon. Therefore, the availability of multiple base editing systems with a wide range of PAMs or a base editing system with a degenerate PAM is useful to access a larger number of potential target sites in the PCSK9 gene. In addition, additional editing systems wherein the frequency of off-target editing is low (e.g. in the range of 1% or less of the on-target editing events) are also useful to perform gene editing in this context.

The efficiency of base editing required for a therapeutic effect is in the range of 50% or higher in order to achieve a significant reduction in plasma lipid levels. An example of the use of a base editor to create a stop codon in the PCSK9 gene is that of Carreras et al (doi.org/10.1186/s12915-018-0624-2) in which between 10% and 34% of the PCSK9 alleles were edited to create a stop codon. While this level of editing was sufficient to result in a measurable reduction in plasma lipid levels in the mice, a higher editing efficiency will be required for therapeutic use in humans.

To identify a base-editing (BE) system and a guide that are optimal for introducing the stop codons in the PCSK9 gene, a screen may be performed in a mouse liver cell line such as Hepa1-6 cells. In silico screening may first be used to identify guides that target the PCSK9 gene with the various BE systems available. To select among the large number of possible guides an in-silico analysis may be performed to determine which guides have an editing window that encompasses a sequence that when edited may create a stop codon. Preference may then be given to those guides that are closer to the 5' end of the coding sequence. The resulting set of guides and BE proteins may be combined to form a ribonucleoprotein complex (RNP) and may be nucleofected into Hepa1-6 cells. After 72 h the efficiency of editing at the target site may be determined by NGS analysis. Based on these in vitro results the one or more BE/guide combinations that resulted in the highest frequency of stop codon formation may be selected for in vivo testing.

For application in a human therapeutic setting a safe and effective method of delivering the base editing components comprising the base editor and the guide RNA is required. In vivo delivery methods can be divided in to viral or non-viral methods. Among viral vectors the Adeno Associated Virus (AAV) is the virus of choice for clinical use due to its safety record, efficient delivery to multiple tissues and cell types and established manufacturing processes. The large size of base editors (BE) exceeds the packaging capacity of AAV which interferes with packaging in a single Adeno Associated Virus. While approaches that package BE into two AAV using split intein technology have been demonstrated to be successful in mice (doi.org/10.1038/s41551-019-0501-5), the need for 2 viruses complicates development and manufacture. An additional disadvantage of AAV is that while the virus does not have a mechanism for promoting integration into the genome of host cells, and most of the AAV genomes remain episomal, a fraction of the AAV genomes do become integrated at random double strand breaks that occur naturally in cells (Curr Opin Mol Ther. 2009 August; 11(4): 442-447). This may lead to the persistence of gene sequences expressing the BE for the life-time of the organism. Moreover, AAV genomes persist as episomes inside the nucleus of transduced cells and can be maintained for years which may result in the long-term expression of BE in these cells and thus an increased risk of off-target effects because the risk of an off-target event occurring is a function of the time over which the editing enzyme is active. Adenovirus (Ad) such as Ad5 can efficiently deliver DNA payloads to the liver of mammals and can package up to 45 kb of DNA. However, adenoviruses are known to induce a strong immune response in mammals (dx.doi.org/10.1136/gut.48.5.733), including in patients which can result in serious adverse events including death (doi.org/10.1016/j.ymthe.2020.02.010).

Non-viral delivery vectors (reviewed in doi:10.1038/mt.2012.79) which include lipid nanoparticles and polymeric nanoparticles have several advantages compared to viral delivery vectors including lower immunogenicity and transient expression of the nucleic acid cargo. The transient expression elicited by non-viral delivery vectors is particularly suited to genome editing applications because it is expected to minimize off target events. In addition, non-viral delivery unlike viral vectors has the potential for repeat administration to achieve the therapeutic effect. There is also no theoretical limit to the size of the nucleic acid molecules that can be packaged in non-viral vectors, although in practice the packaging becomes less efficient as the size of the nucleic acid increases and the particles size may increase.

A BE may be delivered in vivo using a non-viral vector such as a lipid nanoparticle (LNP) by encapsulating a synthetic mRNA encoding the BE together with the guide RNA into the LNP. This can be performed using methodologies well known in the art, for example as described by Finn et al (DOI: 10.1016/j.celrep.2018.02.014) or Yin et al (doi:10.1038/nbt.3471). Typically, LNP deliver their cargo primarily to the hepatocytes of the liver, which is also a target organ/cell type when attempting to interfere with the expression of the PCSK9 gene. In order to demonstrate proof of concept for this approach we envisage that a BE comprised of a novel genome editing protein fused to a deaminase domain may be encoded in a synthetic mRNA and packaged in a LNP together with an appropriate guide RNA that targets the selected site in the PCSK9 gene of the mouse. In the case of mice that were engineered to express the human PCSK9 gene the guide may be designed to target only the human PCSK9 gene or both the human and mouse PCSK9 genes. Following injection of these LNP the editing efficiency at the on-target site in the genome of the liver cells may be analyzed by amplicon sequencing or other methods such as tracking of indels by decomposition (doi: 10.1093/nar/gku936). The physiologic impact may be determined by measuring lipid levels in the blood of the mice, including total cholesterol and triglyceride levels using standard methods.

Another example of a disease that may be modeled in mice to evaluate a novel BE is Primary Hyperoxaluria type I. Primary Hyperoxaluria type I (PH1) is a rare autosomal recessive disease caused by defects in the AGXT gene that encodes the enzyme alanine-glyoxylate aminotransferase. This results in a defect in glyoxylate metabolism and the accumulation of the toxic metabolite oxalate. One approach to treating this disease is to reduce the expression of the enzyme glycolate oxidase (GO) that produces glyoxylate from glycolate and thereby reducing the amount of substrate (glyoxylate) available for the formation of oxalate. PH1 can be modeled in mice in which both copies of the AGXT gene have been knocked out (agxt −/− mice) resulting in a significant 3-fold increase in oxalate levels in the urine compared to wild type controls. The agxt −/− mice can therefore be used to assess the efficacy of a novel base editor designed to create a stop codon in the coding sequence of the endogenous mouse GO gene. To identify a BE system and a guide that is optimal for introducing stop codons in the GO gene, a screen may be performed in a mouse liver cell line such as Hepa1-6 cells. In silico screening may first be used to identify guides that target the GO gene with the various BE systems available. To select among the large number of possible guides an in-silico analysis may be performed to determine which guides have an editing window that encompasses a sequence that when edited may create a stop codon. Preference may then be given to those guides that are closer to the 5' end of the coding sequence. The resulting set of guides and BE proteins may be combined to form a ribonucleoprotein complex (RNP) and may be nucleofected in to Hepa1-6 cells. After 72 h, the efficiency of editing at the target site may be determined by NGS analysis. Based on these in vitro results the one or more BE/guide combinations that resulted in the highest frequency of stop codon formation may be selected for in vivo testing in mice.

The BE and guide may be delivered to the mice using an AAV virus with a split intein system to express the BE and a 3rd AAV to deliver the guide. Alternatively, an Adenovirus type 5 may be used to deliver the BE and guide in a single virus because of the >40Kb packaging capacity of Adenovirus. Further, the BE may be delivered as a mRNA together with the guide RNA packaged in an appropriate LNP. After intravenous injection of the LNP into the agxt −/− mice the oxalate levels in the urine may be monitored over time to determine if oxalate levels were reduced which may indicate that the BE was active and had the expected therapeutic effect. To determine if the BE had introduced the stop codons, the appropriate region of the GO gene can be PCR amplified from the genomic DNA extracted from livers of treated and control mice. The resultant PCR product can be sequenced using Next Generation Sequencing to determine the frequency of the sequence changes.

Example 10.—Gene Discovery of New Deaminases

Tbp (tera base pairs) of proprietary and public assembled metagenomic sequencing data from diverse environments (soil, sediments, groundwater, thermophilic, human, and non-human microbiomes) were mined to discover novel deaminases. HMM profiles of known deaminases were built and searched against all predicted proteins using HMMER3 (hmmer.org) to identify deaminases from our databases. Predicted and reference (e.g., eukaryotic APOBEC1, bacterial TadA) deaminases were aligned with MAFFT and a phylogenetic tree was inferred using FastTree2. Novel families and subfamilies were defined by identifying clades composed of sequences disclosed herein. Candidates were selected based on the presence of critical catalytic residues indicative of enzymatic function (see e.g. SEQ ID NOs: 1-51, 385-386, 387-443, 444-447, or 488-475).

Example 11.—Plasmid Construction

DNA fragments of genes were synthesized at either Twist Bioscience or Integrated DNA Technologies (IDT). Plasmid DNA was amplified in Endura electrocompetent cells (Lucigen) and isolated by QIAprep Spin Miniprep Kit (Qiagen). Vector backbones were prepared by restriction enzyme digestion of plasmids. Inserts were amplified by Q5 High-Fidelity DNA polymerase (New England Biolabs) using primers ordered either from Elim BIOPHARM or IDT. Both vector backbones and inserts were purified by gel extraction using the Gel DNA Recovery Kit (Zymo Research). One or multiple DNA fragments were assembled into the vectors through NEBuilder HiFi DNA assembly (New England Biolabs) (SEQ TD NOs: 483-487).

Example 12.—Assessment of Base Edit Efficiency in *E. coli* by Sequencing 5 ng extracted DNA prepared as in Example 4 was used as the template and primers (P137 and P360) were used for PCR amplification, and the resulting products were submitted for Sanger sequencing at ELIM BIOPHARM. Primers used for sequencing are shown in Tables 6 and 7 (Seq ID NOs: 523-531).

TABLE 6

Primers used for base editing analysis of lacZ gene in *E. coli*

| Name | SEQ ID NO. | Description | Sequence (5'→3') |
| --- | --- | --- | --- |
| P137 | 523 | Forward primer used to amplify lacZ | CCAGGCTTTACACTTTATGCT |
| P360 | 524 | Reverse primer used to amplify lacZ | CGAACATCCAAAAGTTTGTGTTTTT |
| P137 | 523 | Sanger sequencing primer of MGA1-4_site 1 | CCAGGCTTTACACTTTATGCT |
| P137 | 523 | Sanger sequencing primer of MGA1-4_site 2 | CCAGGCTTTACACTTTATGCT |
| P361 | 528 | Sanger sequencing primer of MGA1-4_site 3 | TGAGCGCATTTTTACGCGC |
| P361 | 528 | Sanger sequencing primer of MGA1-6_site 1 | TGAGCGCATTTTTACGCGC |
| P361 | 528 | Sanger sequencing primer of MGA1-6_site 2 | TGAGCGCATTTTTACGCGC |
| P361 | 528 | Sanger sequencing primer of MGA1-6_site 3 | TGAGCGCATTTTTACGCGC |
| P361 | 528 | Sanger sequencing primer of MGA3-6_site 1 | TGAGCGCATTTTTACGCGC |
| P363 | 529 | Sanger sequencing primer of MGA3-6_site 2 | GAAAACGGCAACCCGTGG |
| P360 | 524 | Sanger sequencing primer of MGA3-6_site 3 | CGAACATCCAAAAGTTTGTGTTTTT |
| P137 | 523 | Sanger sequencing primer of MGA3-7_site 1 | CCAGGCTTTACACTTTATGCT |
| P361 | 528 | Sanger sequencing primer of MGA3-7_site 2 | TGAGCGCATTTTTACGCGC |
| P361 | 528 | Sanger sequencing primer of MGA3-7_site 3 | TGAGCGCATTTTTACGCGC |

TABLE 6-continued

Primers used for base editing analysis of lacZ gene in E. coli

| Name | SEQ ID NO. | Description | Sequence (5'→3') |
|---|---|---|---|
| P137 | 523 | Sanger sequencing primer of MGA3-8_site 1 | CCAGGCTTTACACTTTATGCT |
| P361 | 528 | Sanger sequencing primer of MGA3-8_site 2 | TGAGCGCATTTTTACGCGC |
| P363 | 529 | Sanger sequencing primer of MGA3-8_site 3 | GAAAACGGCAACCCGTGG |
| P139 | 526 | Sanger sequencing primer of MGA4-2_site 1 | GTATGTGGTGGATGAAGCC |
| P363 | 529 | Sanger sequencing primer of MGA4-2_site 2 | GAAAACGGCAACCCGTGG |
| P360 | 524 | Sanger sequencing primer of MGA4-2_site 3 | CGAACATCCAAAAGTTTGTGTTTTT |
| P361 | 528 | Sanger sequencing primer of MGA4-5_Site 1 | TGAGCGCATTTTTACGCGC |
| P361 | 528 | Sanger sequencing primer of MGA4-5_Site 2 | TGAGCGCATTTTTACGCGC |
| P461 | 530 | Sanger sequencing primer of MGA4-5_Site 3 | GGATTGAAAATGGTCTGCTG |
| P137 | 523 | Sanger sequencing primer of MGA7-1_site 1 | CCAGGCTTTACACTTTATGCT |
| P361 | 528 | Sanger sequencing primer of MGA7-1_site 2 | TGAGCGCATTTTTACGCGC |
| P461 | 530 | Sanger sequencing primer of MGA7-1_site 3 | GGATTGAAAATGGTCTGCTG |
| P139 | 526 | Sanger sequencing primer of MGA14-1_site 1 | GTATGTGGTGGATGAAGCC |
| P363 | 529 | Sanger sequencing primer of MGA14-1_site 2 | GAAAACGGCAACCCGTGG |
| P360 | 524 | Sanger sequencing primer of MGA14-1_site 3 | CGAACATCCAAAAGTTTGTGTTTTT |
| P137 | 523 | Sanger sequencing primer of MGA15-1_site 1 | CCAGGCTTTACACTTTATGCT |
| P361 | 528 | Sanger sequencing primer of MGA15-1_site 2 | TGAGCGCATTTTTACGCGC |
| P140 | 527 | Sanger sequencing primer of MGA15-1_site 3 | TTGTGGAGCGACATCCAG |
| P137 | 523 | Sanger sequencing primer of MGA16-1_site 1 | CCAGGCTTTACACTTTATGCT |
| P361 | 528 | Sanger sequencing primer of MGA16-1_site 2 | TGAGCGCATTTTTACGCGC |
| P361 | 528 | Sanger sequencing primer of MGA16-1_site 3 | TGAGCGCATTTTTACGCGC |
| P361 | 528 | Sanger sequencing primer of MGA18-1_site 1 | TGAGCGCATTTTTACGCGC |
| P363 | 529 | Sanger sequencing primer of MGA18-1_site 2 | GAAAACGGCAACCCGTGG |
| P462 | 531 | Sanger sequencing primer of MGA18-1_site 3 | ACTGCTGACGCCGCTGCG |
| P363 | 529 | Sanger sequencing primer of ABE8.17_site 1 | GAAAACGGCAACCCGTGG |

TABLE 6-continued

Primers used for base editing analysis of lacZ gene in E. coli

| Name | SEQ ID NO. | Description | Sequence (5'→3') |
|---|---|---|---|
| P137 | 523 | Sanger sequencing primer of ABE8.17_site 2 | CCAGGCTTTACACTTTATGCT |
| P139 | 526 | Sanger sequencing primer of ABE8.17_site 3 | GTATGTGGTGGATGAAGCC |
| P137 | 523 | Sanger sequencing primer of MGC1-4_site 1 | CCAGGCTTTACACTTTATGCT |
| P137 | 523 | Sanger sequencing primer of MGC1-4_site 2 | CCAGGCTTTACACTTTATGCT |
| P361 | 528 | Sanger sequencing primer of MGC1-4_site 3 | TGAGCGCATTTTTACGCGC |
| P137 | 523 | Sanger sequencing primer of MGC1-6_site 1 | CCAGGCTTTACACTTTATGCT |
| P137 | 523 | Sanger sequencing primer of MGC1-6_site 2 | CCAGGCTTTACACTTTATGCT |
| P361 | 528 | Sanger sequencing primer of MGC1-6_site 3 | TGAGCGCATTTTTACGCGC |
| P138 | 525 | Sanger sequencing primer of MGC3-6_site 1 | CCGAAAGGCGCGGTGCCG |
| P361 | 528 | Sanger sequencing primer of MGC3-6_site 2 | TGAGCGCATTTTTACGCGC |
| P360 | 524 | Sanger sequencing primer of MGC3-6_site 3 | CGAACATCCAAAAGTTTGTGTTTTT |
| P137 | 523 | Sanger sequencing primer of MGC3-7_site 1 | CCAGGCTTTACACTTTATGCT |
| P137 | 523 | Sanger sequencing primer of MGC3-7_site 2 | CCAGGCTTTACACTTTATGCT |
| P137 | 523 | Sanger sequencing primer of MGC3-7_site 3 | CCAGGCTTTACACTTTATGCT |
| P137 | 523 | Sanger sequencing primer of MGC3-8_site 1 | CCAGGCTTTACACTTTATGCT |
| P361 | 528 | Sanger sequencing primer of MGC3-8_site 2 | TGAGCGCATTTTTACGCGC |
| P361 | 528 | Sanger sequencing primer of MGC3-8_site 3 | TGAGCGCATTTTTACGCGC |
| P361 | 528 | Sanger sequencing primer of MGC4-2_site 1 | TGAGCGCATTTTTACGCGC |
| P139 | 526 | Sanger sequencing primer of MGC4-2_site 2 | GTATGTGGTGGATGAAGCC |
| P363 | 529 | Sanger sequencing primer of MGC4-2_site 3 | GAAAACGGCAACCCGTGG |
| P137 | 523 | Sanger sequencing primer of MGC4-5_site 1 | CCAGGCTTTACACTTTATGCT |
| P361 | 528 | Sanger sequencing primer of MGC4-5_site 2 | TGAGCGCATTTTTACGCGC |
| P139 | 526 | Sanger sequencing primer of MGC4-5_site 3 | GTATGTGGTGGATGAAGCC |
| P361 | 528 | Sanger sequencing primer of MGC7-1_site 1 | TGAGCGCATTTTTACGCGC |

TABLE 6-continued

Primers used for base editing analysis of lacZ gene in E. coli

| Name | SEQ ID NO. | Description | Sequence (5'→3') |
|---|---|---|---|
| P461 | 530 | Sanger sequencing primer of MGC7-1_site 2 | GGATTGAAAATGGTCTGCTG |
| P139 | 526 | Sanger sequencing primer of MGC7-1_site 3 | GTATGTGGTGGATGAAGCC |
| P137 | 523 | Sanger sequencing primer of MGC14-1_site 1 | CCAGGCTTTACACTTTATGCT |
| P139 | 526 | Sanger sequencing primer of MGC14-1_site 2 | GTATGTGGTGGATGAAGCC |
| P139 | 526 | Sanger sequencing primer of MGC14-1_site 3 | GTATGTGGTGGATGAAGCC |
| P361 | 528 | Sanger sequencing primer of MGC15-1_site 1 | TGAGCGCATTTTTACGCGC |
| P461 | 530 | Sanger sequencing primer of MGC15-1_site 2 | GGATTGAAAATGGTCTGCTG |
| P139 | 526 | Sanger sequencing primer of MGC15-1_site 3 | GTATGTGGTGGATGAAGCC |
| P137 | 523 | Sanger sequencing primer of MGC16-1_site 1 | CCAGGCTTTACACTTTATGCT |
| P137 | 523 | Sanger sequencing primer of MGC16-1_site 2 | CCAGGCTTTACACTTTATGCT |
| P361 | 528 | Sanger sequencing primer of MGC16-1_site 3 | TGAGCGCATTTTTACGCGC |
| P361 | 528 | Sanger sequencing primer of MGC18-1_site 1 | TGAGCGCATTTTTACGCGC |
| P139 | 526 | Sanger sequencing primer of MGC18-1_site 2 | GTATGTGGTGGATGAAGCC |
| P363 | 529 | Sanger sequencing primer of MGC18-1_site 3 | GAAAACGGCAACCCGTGG |
| P363 | 529 | Sanger sequencing primer of BE3_site 1 | GAAAACGGCAACCCGTGG |
| P360 | 524 | Sanger sequencing primer of BE3_site 2 | CGAACATCCAAAAGTTTGTGTTTTT |
| P137 | 523 | Sanger sequencing primer of BE3_site 3 | CCAGGCTTTACACTTTATGCT |

TABLE 7

Primers used for base editing analysis of the effect of uracil glycosylase inhibitor (UGI) in E. coli

| Name | SEQ ID NO. | Description | Sequence (5'→3') |
|---|---|---|---|
| P137 | 523 | Forward primer used to amplify lacZ | CCAGGCTTTACACTTTATGCT |
| P360 | 524 | Reverse primer used to amplify lacZ | CGAACATCCAAAAGTTTGTGTTTTT |
| P461 | 530 | Sanger sequencing primer of lacZ site | GGATTGAAAATGGTCTGCTG |

Figure 8A:
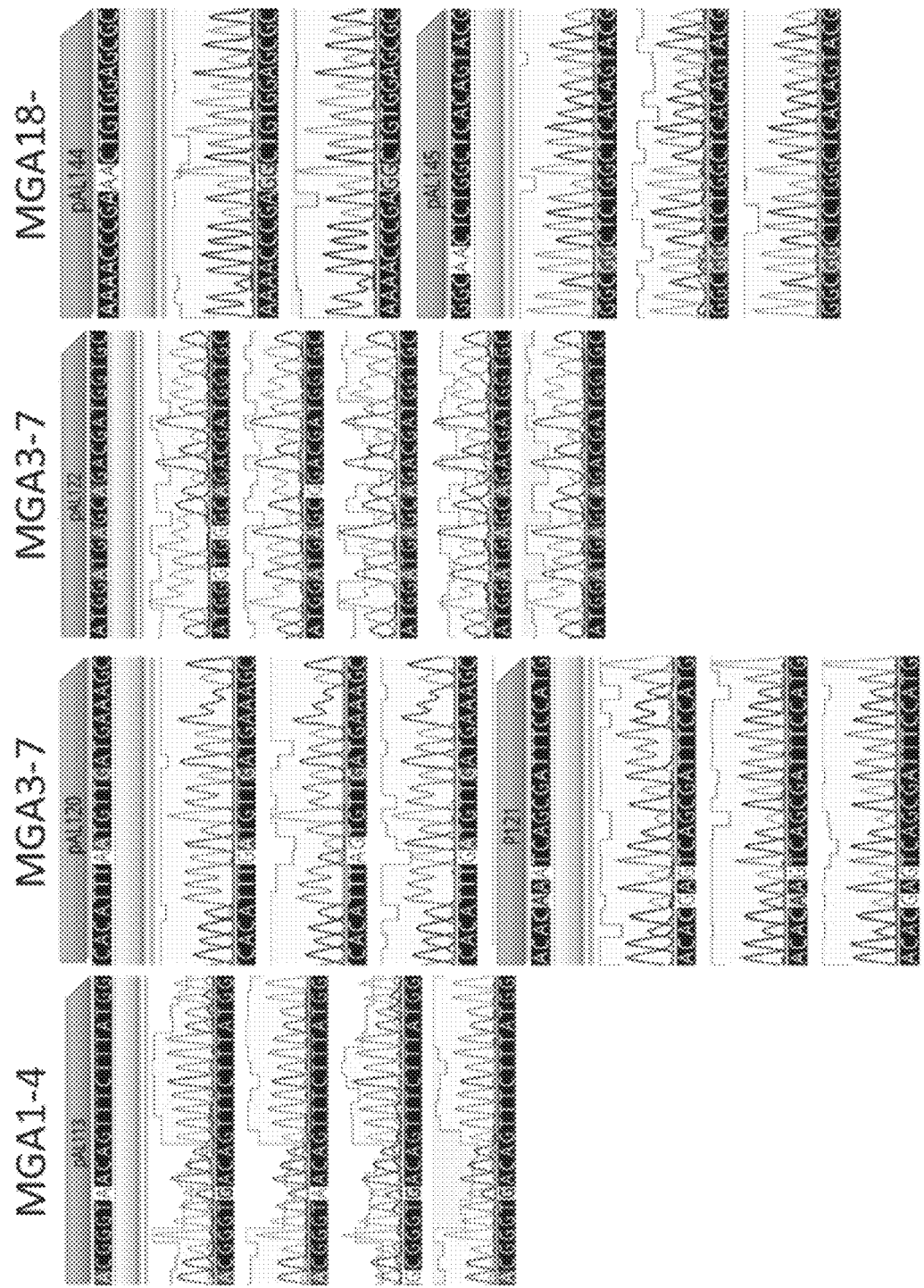
FIGS. 8A, 8B, and 8C shows Sanger sequencing results demonstrating base edits by selected systems described herein.
Figure 8B:
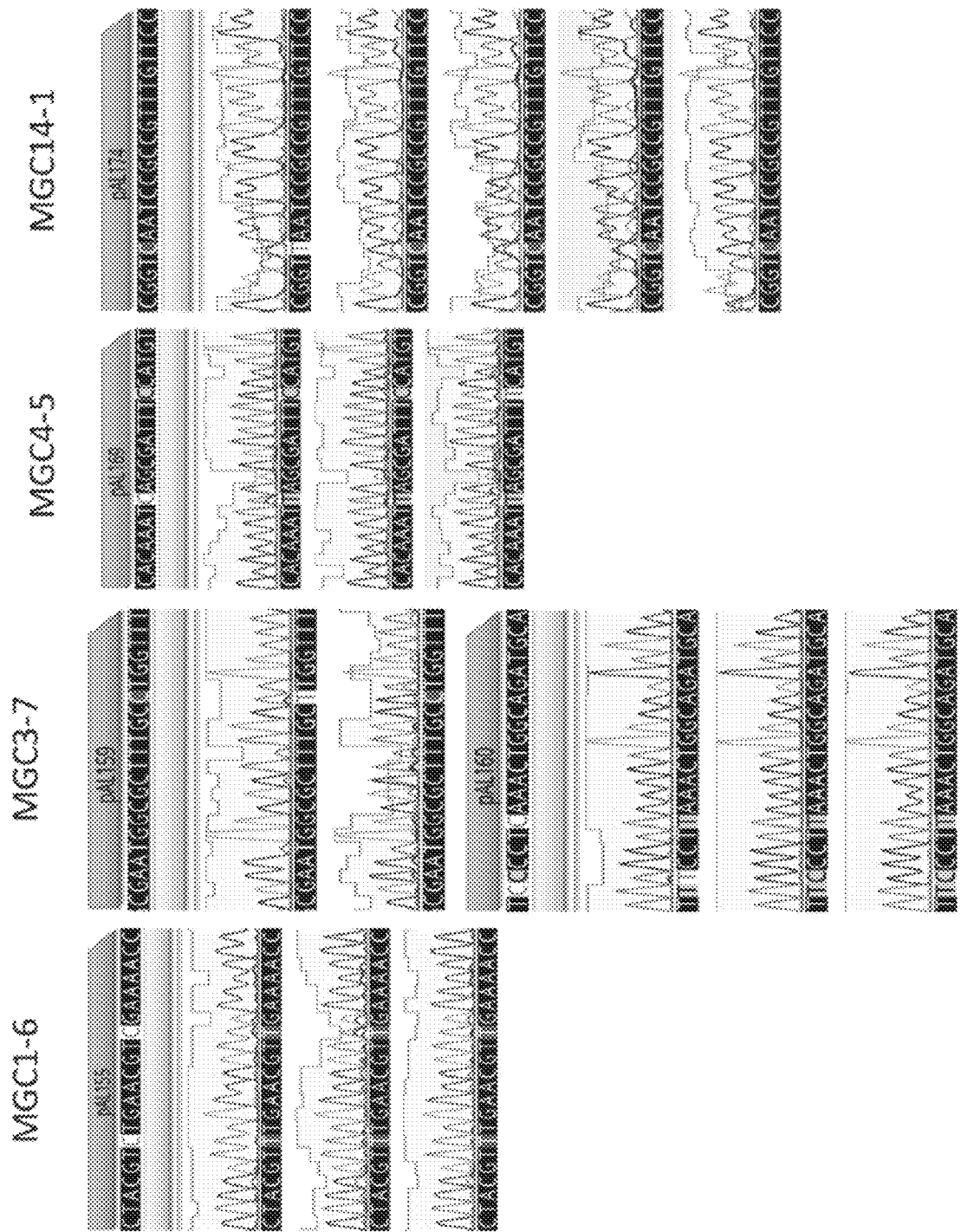
Figure 8C:
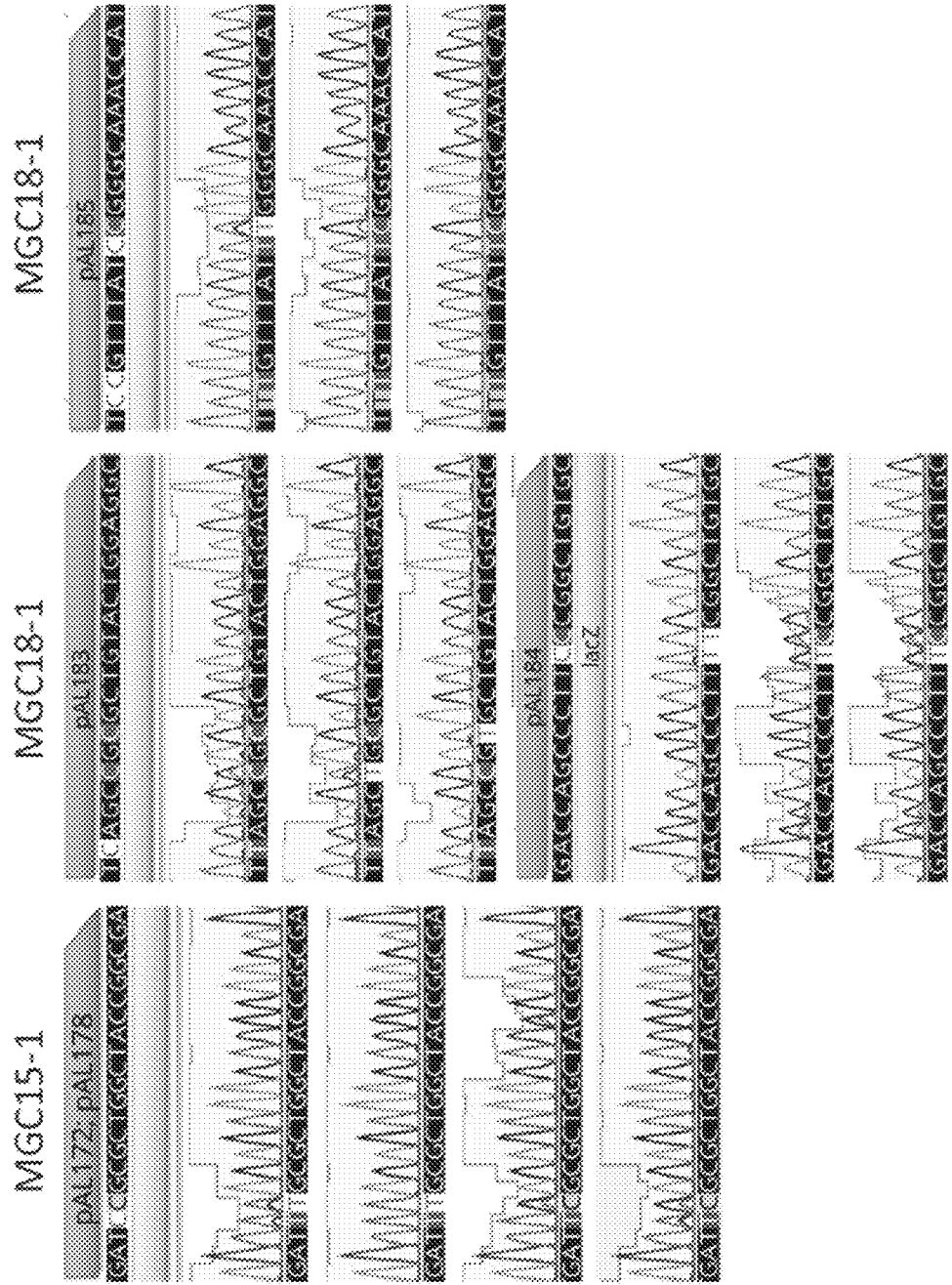
Figure 9:
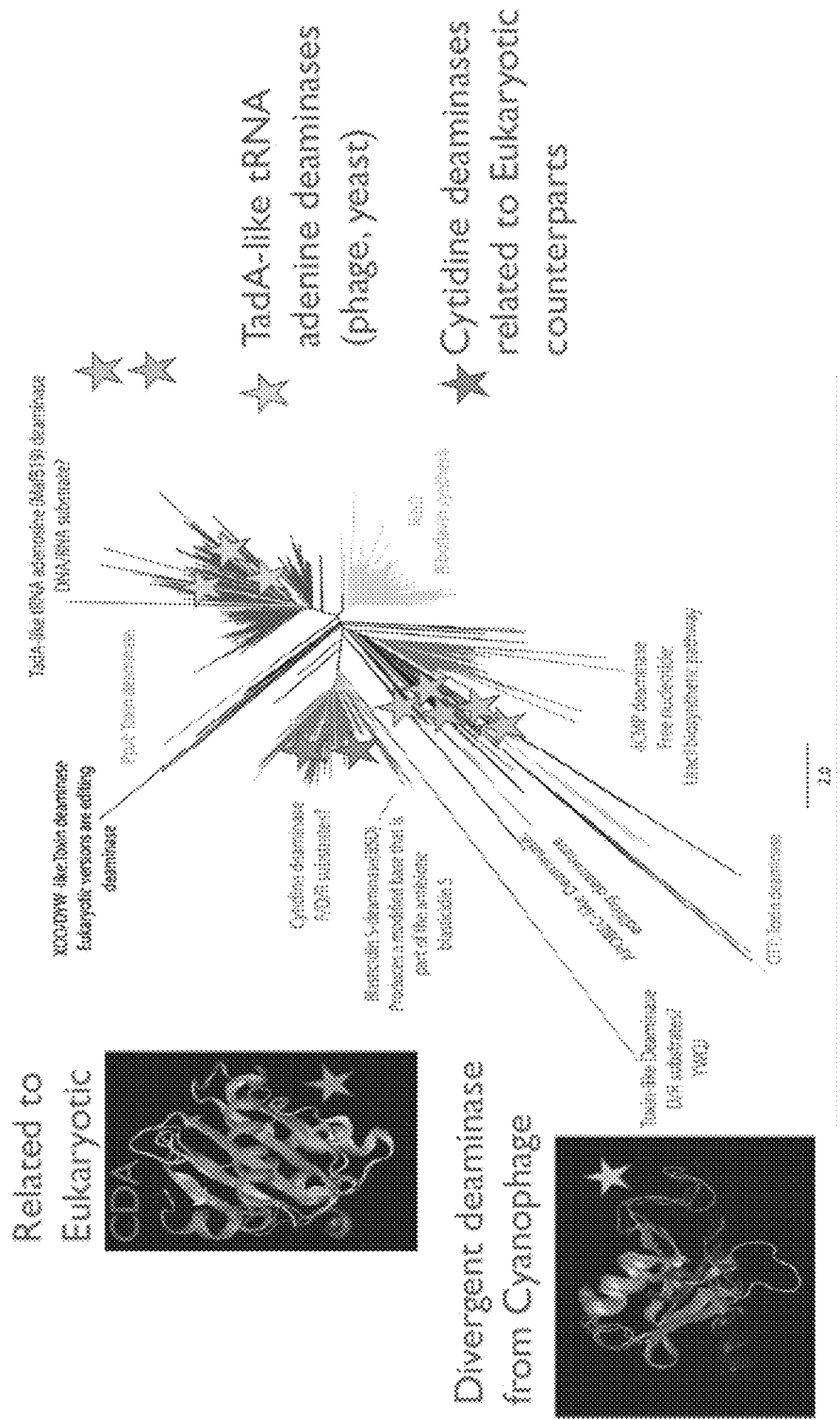
FIG. 9 shows how the systems described herein expand base-editing capabilities with the endonucleases and base editors described herein.

FIGS. 8A-8C show example base edits by enzymes interrogated by this experiment, as assessed by Sanger sequencing.

Figure 10A:
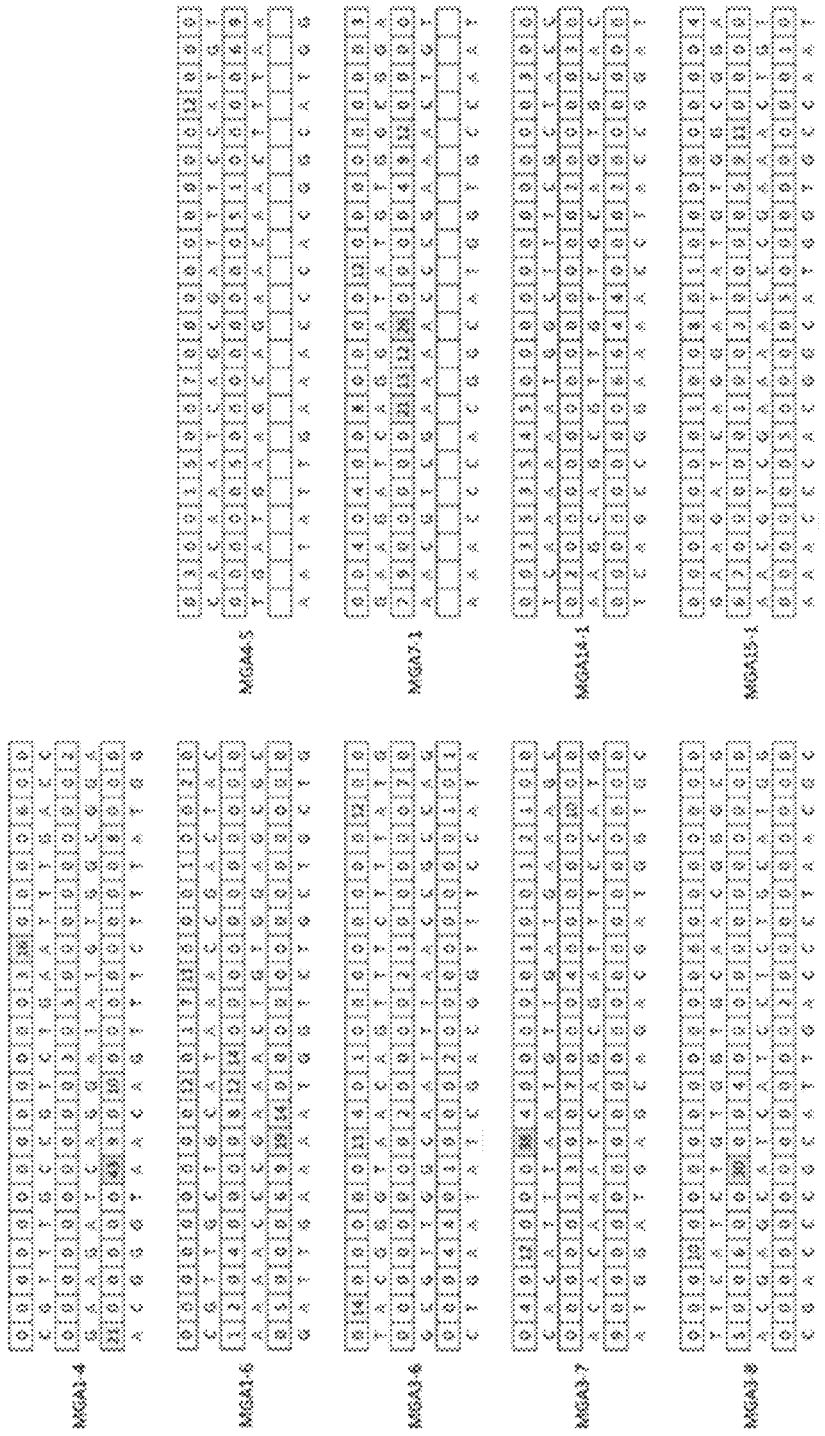
Figure 10B:
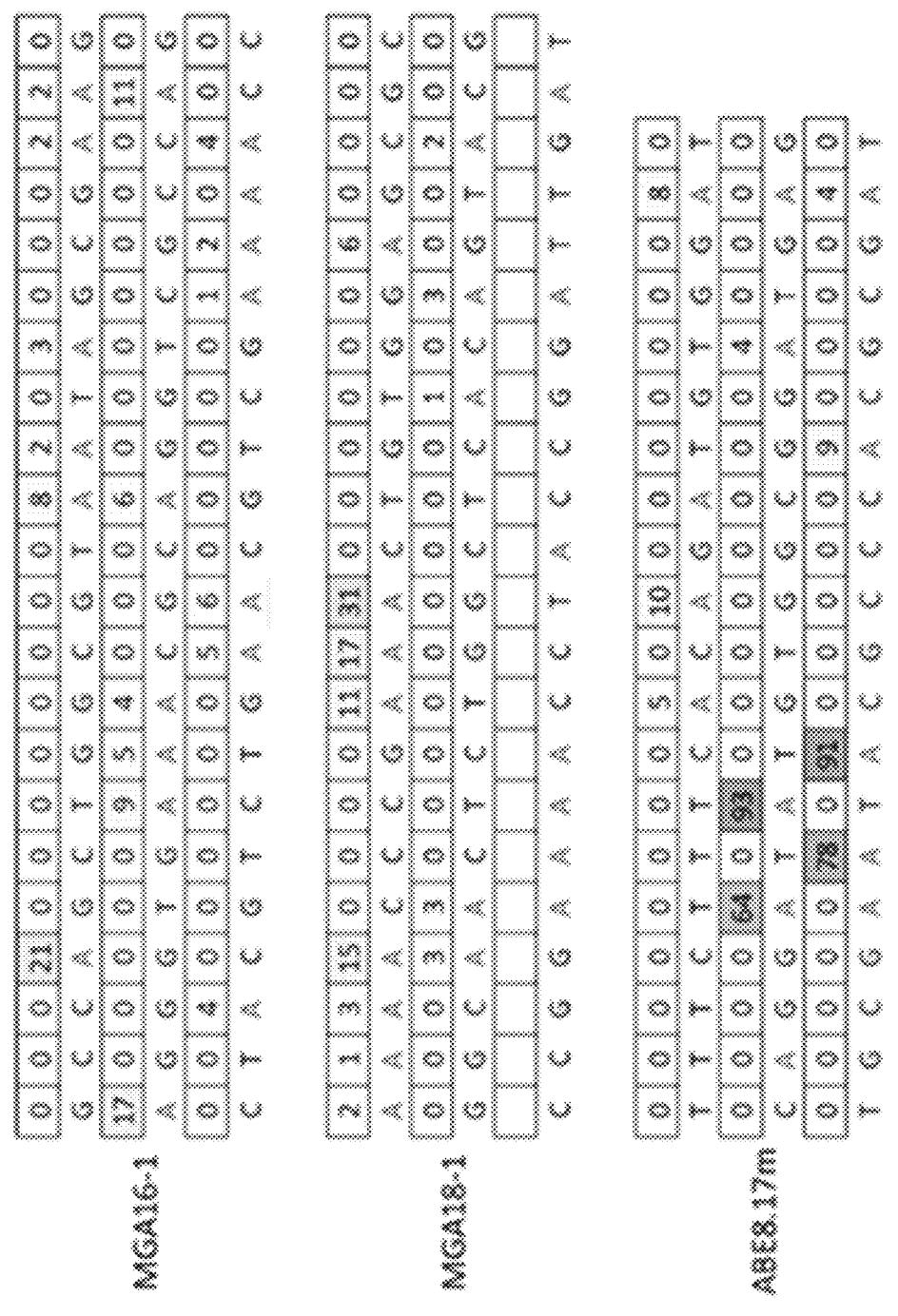

FIGS. 10A-10B show base editing efficiencies of adenine base editors (ABEs) using TadA (ABE8.17m) (SEQ TD NO: 596) and MG nickases according to Table 3. TadA is a tRNA adenosine deaminase; TadA (ABE8.17m) is an engineered variant of E. coli TadA. Twelve MG nickases fused with TadA (ABE8.17m) were constructed and tested in E. coli. Three guides were designed to target lacZ. Numbers shown in boxes indicate percentages of A to G conversion quantified by Edit R at each position. ABE8.17m was used as the positive control for the experiment.

Figure 11A:
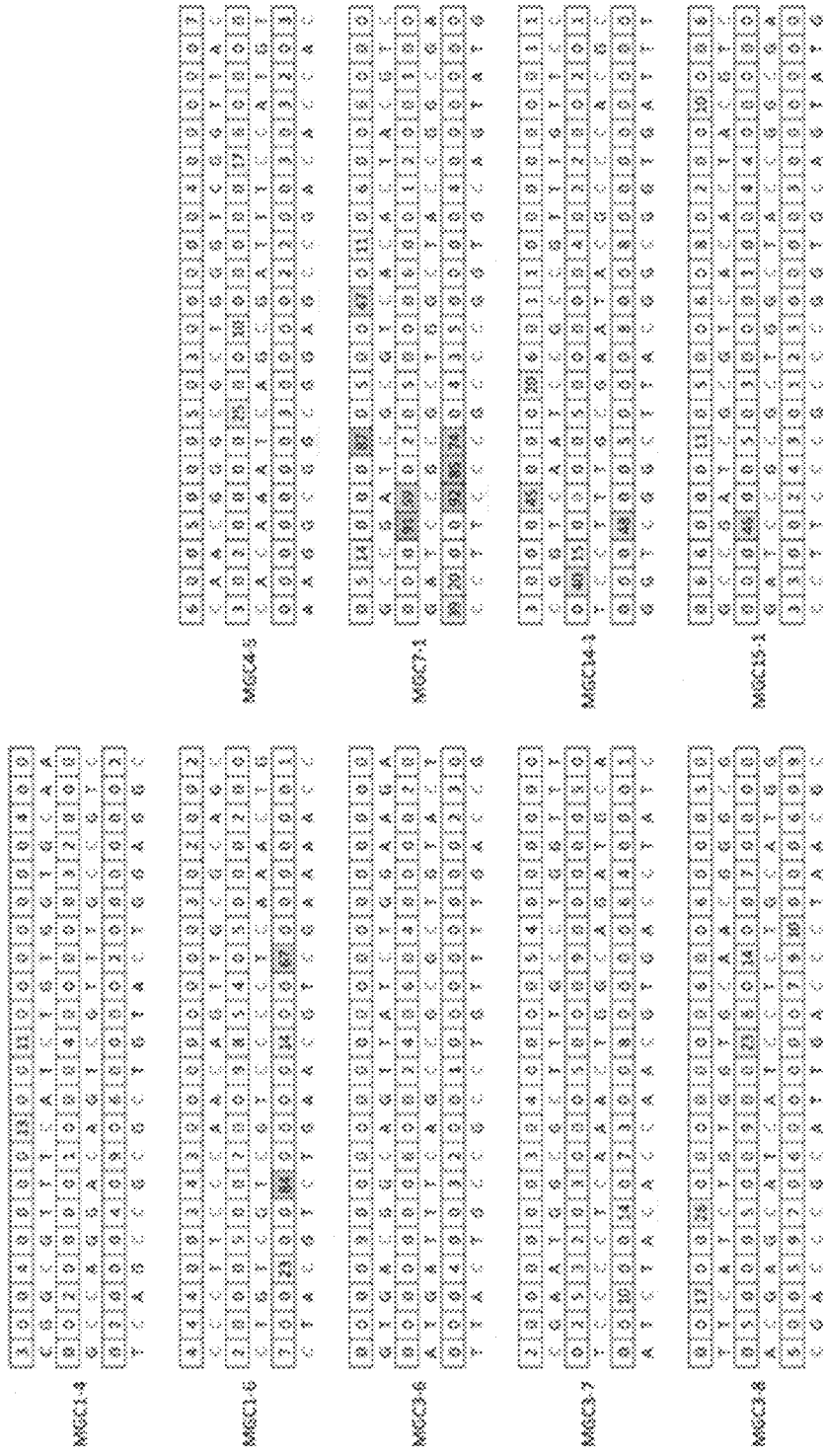

FIGS. 11A-11B show base editing efficiencies of cytosine base editors (CBEs) comprising rat APOBEC1, MG nickases, and uracil glycosylase inhibitor of Bacillus subtilis bacteriophage (UGI (PBS1)). APOBEC1 is a cytosine deaminase. 12 MG nickases fused with rAPOBEC1 on N-terminus and UGI on C-terminus were constructed and tested in E. coli. Three guides were designed to target lacZ. Numbers shown in boxes indicate percentages of C to T conversion quantified by Edit R. BE3 was used as the positive control in the experiment.

Figure 12:
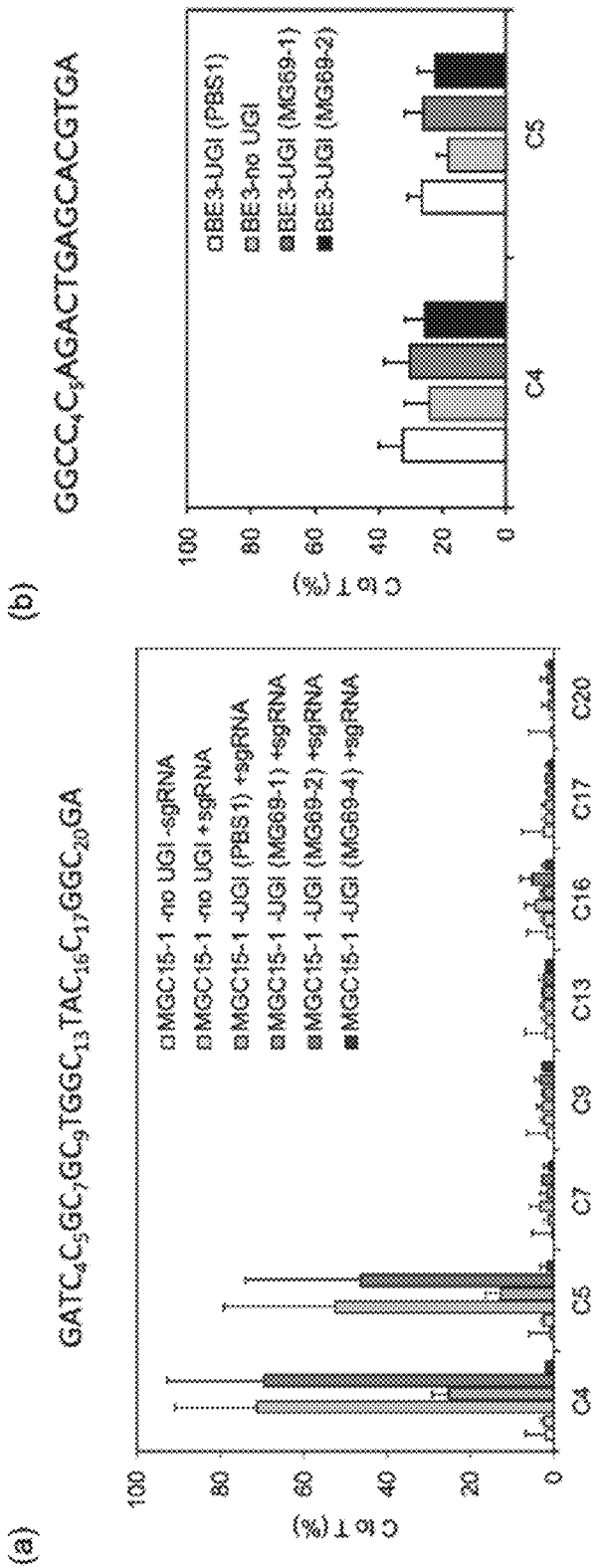
FIG. 12 shows effects of MG uracil glycosylase inhibitors (UGIs) on the base-editing activities of CBEs. Panel (a) depicts a graph showing base-editing activity of MGC15-1 and variants, which comprise an N-terminal APOBEC1, the MG15-1 nickase, and a C-terminal UGI. Three MG UGIs were tested for improvements of cytosine base editing activities in E. coli. Panel (b) is a graph showing base editing activity of BE3, which comprises an N-terminal rAPOBEC1, the SpCas9 nickase, and a C-terminal UGI. Two MG UGIs were tested for improvements of cytosine base editing activities in HEK293T cells. Editing efficiencies were quantified by Edit R.

FIG. 12 shows effects of MG uracil glycosylase inhibitors (UGIs) on base editing activity when added to CBEs. (a) MGC15-1 comprises of N-terminal APOBEC1, MG15-1 nickase, and C-terminal UGI. Three MG UGIs were tested for improvements of cytosine base editing activities in E. coli. (b) BE3 comprises N-terminal rAPOBEC1, SpCas9 nickase, and C-terminal UGI. Two MG UGIs were tested for improvements of cytosine base editing activities in HEK293T cells. Editing efficiencies were quantified by Edit R.

Example 13.—Cell Culture, Transfections, Next Generation Sequencing, and Base Edit Analysis HEK293T cells were grown and passaged in Dulbecco's Modified Eagle's Medium plus GlutaMAX (Gibco) supplemented with 10% (v/v) fetal bovine serum (Gibco) at 37° C. with 5% $CO_2$. $5\times10^4$ cells were seeded on 96-well cell culture plates treated for cell attachment (Costar), grown for 20 to 24 h, and the spent media were refreshed with new media right before transfection. 200 ng expression plasmid and 1 µL lipofectamine 2000 (ThermoFisher Scientific) were used for transfection per well per manufacturer's instructions. Transfected cells were grown for 3 days, harvested, and gDNA was extracted with QuickExtract (Lucigen) per manufacturer's instructions. Targeted regions for base edits were amplified using Q5 High-Fidelity DNA polymerase (New England Biolabs) with primers listed in Tables 8 and 9 (SEQ ID NOs: 538-585) and extracted DNA as the templates.

TABLE 8

Primers used for base edit analysis of the effect of UGI in HEK293T

| Name | SEQ ID NO. | Description | Sequence (5'→3') |
|---|---|---|---|
| P577 | 536 | Forward primer used to amplify the targeted region | GAGGCTGGAGAGGCCCGT |
| P578 | 537 | Reverse primer used to amplify the targeted region | GATTTTCATGCAGGTGCTGAAA |
| P577 | 536 | Sanger sequencing primer | GAGGCTGGAGAGGCCCGT |

TABLE 9a

Primers used to amplify targeted regions in HEK293T cells transfected with A0A2K5RND7-MG nickase-MG69-1

| Name | SEQ ID NO. | Description | Sequence (5'→3') |
|---|---|---|---|
| P969 | 538 | Forward primer used to amplify A0A2K5RDN7-nSpCas9(D10A)-MG69-1_site 1 | GCTCTTCCGATCTNNNNNAGGAG GAAGGGCCTGAGT |
| P970 | 539 | Reverse primer used to amplify A0A2K5RDN7-nSpCas9(D10A)-MG69-1_site 1 | GCTCTTCCGATCTNNNNNTCTGC CCTCGTGGGTTTG |
| P971 | 540 | Forward primer used to amplify A0A2K5RDN7-nSpCas9(D10A)-MG69-1_site 2 | GCTCTTCCGATCTNNNNNCTCTG GCCACTCCCTGGC |
| P972 | 541 | Reverse primer used to amplify A0A2K5RDN7-nSpCas9(D10A)-MG69-1_site 2 | GCTCTTCCGATCTNNNNNGGCAG GCTCTCCGAGGAG |
| P973 | 542 | Forward primer used to amplify A0A2K5RDN7-nSpCas9(D10A)-MG69-1_site 3 | GCTCTTCCGATCTNNNNNGGGAA TAATAAAAGTCTCTCTCTTAA |

TABLE 9a-continued

Primers used to amplify targeted regions in HEK293T cells transfected with A0A2K5RND7-MG nickase-MG69-1

| Name | SEQ ID NO. | Description | Sequence (5'→3') |
|---|---|---|---|
| P974 | 543 | Reverse primer used to amplify A0A2K5RDN7-nSpCas9(D10A)-MG69-1_site 3 | GCTCTTCCGATCTNNNNNCCCCC TCCACCAGTACCC |
| P975 | 544 | Forward primer used to amplify A0A2K5RDN7-nSpCas9(D10A)-MG69-1_site 4 | GCTCTTCCGATCTNNNNNCCTGT CCTTGGAGAACCG |
| P976 | 545 | Reverse primer used to amplify A0A2K5RDN7-nSpCas9(D10A)-MG69-1_site 4 | GCTCTTCCGATCTNNNNNGCAGG TGAACACAAGAGCT |
| P977 | 546 | Forward primer used to amplify A0A2K5RDN7-nSpCas9(D10A)-MG69-1_site 5 | GCTCTTCCGATCTNNNNNGAAGG TGTGGTTCCAGAAC |
| P978 | 547 | Reverse primer used to amplify A0A2K5RDN7-nSpCas9(D10A)-MG69-1_site 5 | GCTCTTCCGATCTNNNNNTCGAT GTCCTCCCCATTG |
| P979 | 548 | Forward primer used to amplify A0A2K5RDN7-nMG1-4(D9A)-MG69-1_site 1 | GCTCTTCCGATCTNNNNNAAACA GGCTAGACATAGGGA |
| P980 | 549 | Reverse primer used to amplify A0A2K5RDN7-nMG1-4(D9A)-MG69-1_site 1 | GCTCTTCCGATCTNNNNNGAAGC CACCAGAGTCTCTA |
| P981 | 550 | Forward primer used to amplify A0A2K5RDN7-nMG1-4(D9A)-MG69-1_site 2 | GCTCTTCCGATCTNNNNNGCCGC CATTGACAGAGGG |
| P982 | 551 | Reverse primer used to amplify A0A2K5RDN7-nMG1-4(D9A)-MG69-1_site 2 | GCTCTTCCGATCTNNNNNGCATC AAAACAAAGGGAGATTG |
| P983 | 552 | Forward primer used to amplify A0A2K5RDN7-nMG1-4(D9A)-MG69-1_site 3 | GCTCTTCCGATCTNNNNNCCTCT GCCCACCTCACTT |
| P984 | 553 | Reverse primer used to amplify A0A2K5RDN7-nMG1-4(D9A)-MG69-1_site 3 | GCTCTTCCGATCTNNNNNGCCAT GTGGGTTAATCTGG |
| P985 | 554 | Forward primer used to amplify A0A2K5RDN7-nMG1-4(D9A)-MG69-1_site 4 | GCTCTTCCGATCTNNNNNCCGGA CGCACCTACCCAT |
| P986 | 555 | Reverse primer used to amplify A0A2K5RDN7-nMG1-4(D9A)-MG69-1_site 4 | GCTCTTCCGATCTNNNNNCTAGA TGGGAATGGATGGG |
| P987 | 556 | Forward primer used to amplify A0A2K5RDN7-nMG3-6(D13A)-MG69-1_site 1 | GCTCTTCCGATCTNNNNNAACCA CAAACCCACGAGG |
| P988 | 557 | Reverse primer used to amplify A0A2K5RDN7-nMG3-6(D13A)-MG69-1_site 1 | GCTCTTCCGATCTNNNNNTCAAT GGCGGCCCCGGGC |
| P989 | 558 | Forward primer used to amplify A0A2K5RDN7-nMG3-6(D13A)-MG69-1_site 2 | GCTCTTCCGATCTNNNNNAGTGA TCCCCAGTGTCCC |
| P990 | 559 | Reverse primer used to amplify A0A2K5RDN7-nMG3-6(D13A)-MG69-1_site 2 | GCTCTTCCGATCTNNNNNGCCCT GAACGCGTTTGCT |
| P991 | 560 | Forward primer used to amplify A0A2K5RDN7-nMG3-6(D13A)-MG69-1_site 3 | GCTCTTCCGATCTNNNNNTGGGA ATAATAAAGTCTCTCTCT |

TABLE 9a-continued

Primers used to amplify targeted regions in HEK293T cells transfected with A0A2K5RND7-MG nickase-MG69-1

| Name | SEQ ID NO. | Description | Sequence (5'→3') |
|---|---|---|---|
| P992 | 561 | Reverse primer used to amplify A0A2K5RDN7-nMG3-6 D13A)-MG69-1_site 3 | GCTCTTCCGATCTNNNNNGCCCTCCACCAGTACCCC |
| P993 | 562 | Forward primer used to amplify A0A2K5RDN7-nMG3-6(D13A)-MG69-1_site 4 | GCTCTTCCGATCTNNNNNCAGGGCCTCCTCAGCCCA |
| P994 | 563 | Reverse primer used to amplify A0A2K5RDN7-nMG3-6(D13A)-MG69-1_site 4 | GCTCTTCCGATCTNNNNNGTCTGGATGTCGTAAGGGAA |
| P995 | 564 | Forward primer used to amplify A0A2K5RDN7-nMG3-6(D13A)-MG69-1_site 5 | GCTCTTCCGATCTNNNNNGGGGTGTAACTCAGAATGTTTT |
| P996 | 565 | Reverse primer used to amplify A0A2K5RDN7-nMG3-6(D13A)-MG69-1_site 5 | GCTCTTCCGATCTNNNNNGGGAGTGAGACTCAGAGA |
| P997 | 566 | Forward primer used to amplify A0A2K5RDN7-nMG3-6(D13A)-MG69-1_site 6 | GCTCTTCCGATCTNNNNNGCAAAGAGGGAAATGAGATCA |
| P998 | 567 | Reverse primer used to amplify A0A2K5RDN7-nMG3-6(D13A)-MG69-1_site 6 | GCTCTTCCGATCTNNNNNGTGACACATTTGTTTGAGAATCA |
| P999 | 568 | Forward primer used to amplify A0A2K5RDN7-nMG3-6(D13A)-MG69-1_site 7 | GCTCTTCCGATCTNNNNNCTTTATCCCCGCACAGAG |
| P1000 | 569 | Reverse primer used to amplify A0A2K5RDN7-nMG3-6(D13A)-MG69-1_site 7 | GCTCTTCCGATCTNNNNNCTTGGCCCATGGGAAATC |
| P1001 | 570 | Forward primer used to amplify A0A2K5RDN7-nMG4-2(D28A)-MG69-1_site 1 | GCTCTTCCGATCTNNNNNGTCCCATCCCAACACCCC |
| P1002 | 571 | Reverse primer used to amplify A0A2K5RDN7-nMG4-2(D28A)-MG69-1_site 1 | GCTCTTCCGATCTNNNNNTGGGCATGTGTGCTCCCA |
| P1003 | 572 | Forward primer used to amplify A0A2K5RDN7-nMG4-2(D28A)-MG69-1_site 2 | GCTCTTCCGATCTNNNNNCTATGGGAATAATAAAGTCTCTC |
| P1004 | 573 | Reverse primer used to amplify A0A2K5RDN7-nMG4-2(D28A)-MG69-1_site 2 | GCTCTTCCGATCTNNNNNCTCCACCAGTACCCCACC |
| P1005 | 574 | Forward primer used to amplify A0A2K5RDN7-nMG4-2(D28A)-MG69-1_site 3 | GCTCTTCCGATCTNNNNNGGACCCTGGTCTCTACCT |
| P1006 | 575 | Reverse primer used to amplify A0A2K5RDN7-nMG4-2(D28A)-MG69-1_site 3 | GCTCTTCCGATCTNNNNNCCTCTCCCATTGAACTACC |
| P1007 | 576 | Forward primer used to amplify A0A2K5RDN7-nMG4-2(D28A)-MG69-1_site 4 | GCTCTTCCGATCTNNNNNCCCCAGTGACTCAGGGCC |
| P1008 | 577 | Reverse primer used to amplify A0A2K5RDN7-nMG4-2(D28A)-MG69-1_site 4 | GCTCTTCCGATCTNNNNNTCGTAAGGGAAAGACTTAGGAA |
| P1009 | 578 | Forward primer used to amplify A0A2K5RDN7-nMG18-1(D12A)-MG69-1_site 1 | GCTCTTCCGATCTNNNNNTCTCCCTTTTGTTTGATGCATTT |

TABLE 9a-continued

Primers used to amplify targeted regions in HEK293T cells transfected with A0A2K5RND7-MG nickase-MG69-1

| Name | SEQ ID NO. | Description | Sequence (5'→3') |
|---|---|---|---|
| P1010 | 579 | Reverse primer used to amplify A0A2K5RDN7-nMG18-1(D12A)-MG69-1_site 1 | GCTCTTCCGATCTNNNNNCCACC CCAGGCTCTGGGG |
| P1011 | 580 | Forward primer used to amplify A0A2K5RDN7-nMG18-1(D12A)-MG69-1_site 2 | GCTCTTCCGATCTNNNNNCCTTT TGTTTTGATGCATTTCTGTTT |
| P1012 | 581 | Reverse primer used to amplify A0A2K5RDN7-nMG18-1(D12A)-MG69-1_site 2 | GCTCTTCCGATCTNNNNNAATCT ACCACCCCAGGCT |
| P1013 | 582 | Forward primer used to amplify A0A2K5RDN7-nMG18-1(D12A)-MG69-1_site 3 | GCTCTTCCGATCTNNNNNATCCC CAGTGTCCCCCTT |
| P1014 | 583 | Reverse primer used to amplify A0A2K5RDN7-nMG18-1(D12A)-MG69-1_site 3 | GCTCTTCCGATCTNNNNNCCAGG CCCTGAACGCGTT |
| P1015 | 584 | Forward primer used to amplify A0A2K5RDN7-nMG18-1(D12A)-MG69-1_site 4 | GCTCTTCCGATCTNNNNNAGGCC AGGCCTGCGGGGG |
| P1016 | 585 | Reverse primer used to amplify A0A2K5RDN7-nMG18-1(D12A)-MG69-1_site 4 | GCTCTTCCGATCTNNNNNCCAAA AACTCCCAAATTAGCAAA |

PCR products were purified using the HighPrep PCR Clean-up System (MAGBIO) per manufacturer's instructions. The effect of uracil glycosylase inhibitor (UGI) on base editing of candidate enzymes was analyzed by submitting PCR products to Elim BIOPHARM for Sanger sequencing, and the efficiency was quantified by Edit R. To analyze base editing of AOA2K5RND7-MG nickase-MG69-1, adapters used for next generation sequencing (NGS) were appended to PCR products by subsequent PCR reactions using KAPA HiFi HotStart ReadyMix PCR Kit (Roche) and primers compatible with TruSeq DNA Library Prep Kits (illumina). DNA concentrations of the resulting products were quantified by TapeStation (Agilent), and samples were pooled together to prepare the library for NGS analysis. The resulting library was quantified by qPCR with Aria Real-time PCR System (Agilent) and high through sequencing was performed with an Illumina Miseq instrument per manufacturer's instructions. Sequencing data was analyzed for base edits by Cripresso2.

Figure 13A:
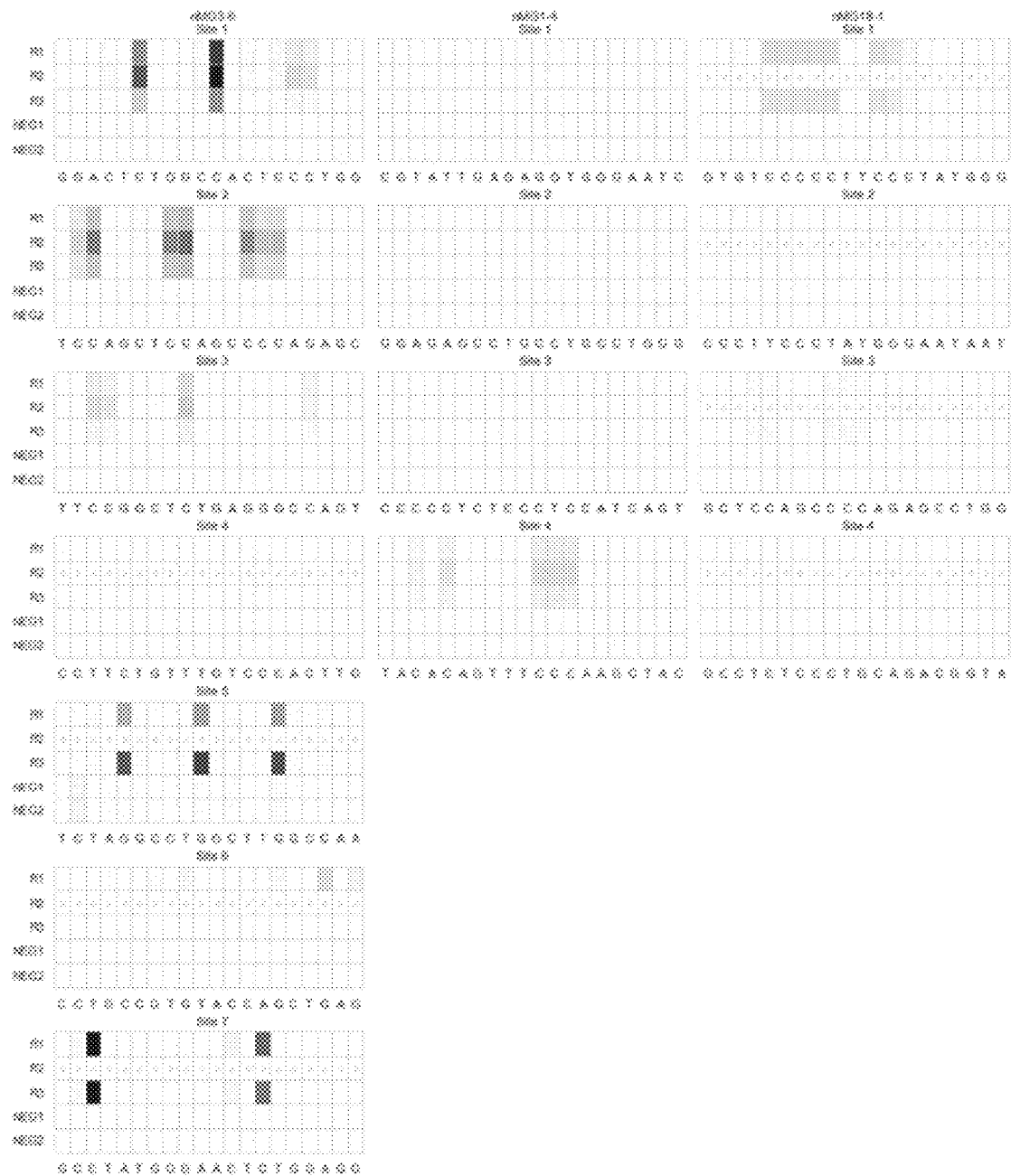
FIGS. 13A and 13B depicts maps of edited sites showing editing efficiencies of cytosine base editors comprising AOA2K5RDN7, an MG nickases, and an MG UGI. The constructs comprise an N-terminal AOA2K5RDN7, an MG nickases, and a C-terminal MG69-1. For simplicity, only the identities of MG nickases are shown in the figure. BE3 was used as the positive control for base editing. An empty vector was used for the negative control. Three independent experiments were performed on different days. Abbreviations: R, repeat; NEG, negative control.
Figure 13B:
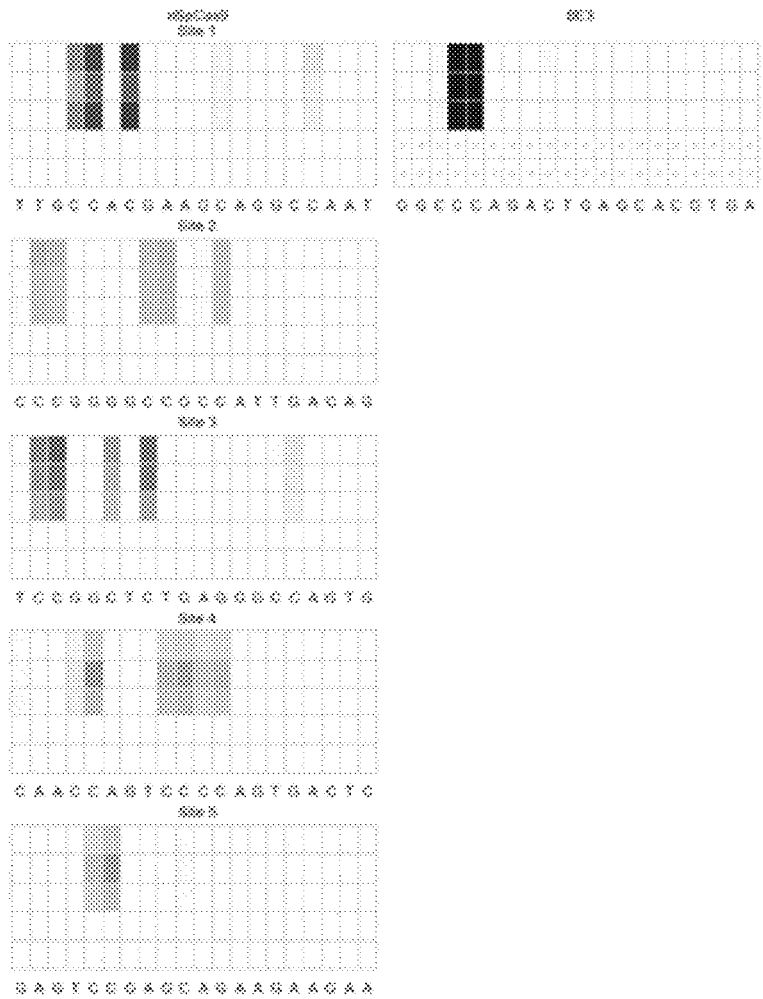

FIGS. 13A-13B show maps of sites targeted by base editors showing base editing efficiencies of cytosine base editors comprising CMP/dCMP-type deaminase domain-containing protein (uniprot accession AOA2K5RDN7), MG nickases, and MG UGL. The constructs comprise N-terminal AOA2K5RDN7, MG nickases, and C-terminal MG69-1. For simplicity, only the identities of MG nickases are shown in the figure. BE3 (APOBEC1) was used as a positive control for base editing. An empty vector was used for the negative control. Three independent experiments were performed on different days. Abbreviations: R, repeat; NEG, negative control.

TABLE 9b

Protein Domains used in constructs in Example 13

| Candidate | Type | PAM | Deaminase | Linker (Deaminase-Nickase) | Nickase | UGI | Linker (Nickase-UGI) |
|---|---|---|---|---|---|---|---|
| A0A2K5RDN7-nMG3-6-MG69-1 | II | nnRGGnT SEQ ID NO: 362 | A0A2K5RDN7 SEQ ID NO: 594 | SGSETPGT SESATPES | nMG3-6(D13A) SEQ ID NO: 71 | MG69-1 SEQ ID NO: 52 | SGGSS |
| A0A2K5RDN7-nMG1-4-MG69-1 | II | nRRR SEQ ID NO: 360 | A0A2K5RDN7 SEQ ID NO: 594 | SGSETPGT SESATPES | nMG1-4 SEQ ID NO:70 | MG69-1 SEQ ID NO: 52 | SGGSS |
| A0A2K5RDN7-nMG18-1-MG69-1 | II | nRWART SEQ ID NO: 368 | A0A2K5RDN7 SEQ ID NO: 594 | SGSETPGT SESATPES | nMG18-1 SEQ ID NO: 78 | MG69-1 SEQ ID NO: 52 | SGGSS |

Example 14.—Positive Selection of Base Editor Mutants in *E. coli*

Figure 14:
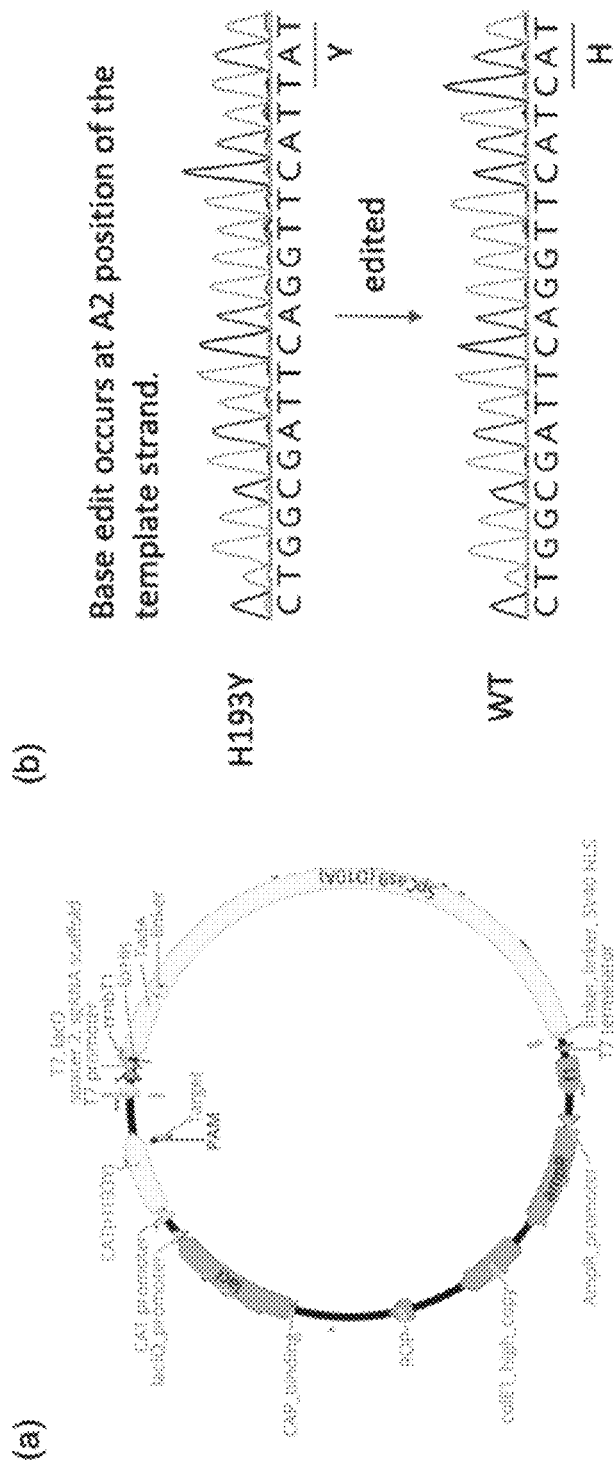
FIG. 14 shows a positive selection method for TadA characterization in *E. coli*. Panel (a) shows a map of one plasmid system used for TadA selection. The vector comprises CAT (H193Y), a sgRNA expression cassette targeting CAT, and an ABE expression cassette. In this figure, N-terminal TadA from *E. coli* and a C-terminal SpCas9 (D10A) from *Streptococcus pyogenes* are shown. Panel (b) shows sequencing traces demonstrating that when introduced/transformed into *E. coli* cells, the A2 position of CAT (H193Y)'s template strand is edited, reverting the H193Y mutant to wild type and restoring its activity. Abbreviations: CAT, chloramphenicol acetyltransferase. Figure discloses SEQ ID NOS 692-694, respectively, in order of appearance.

FIG. 14 shows a positive selection method for TadA characterization in *E. coli*. Panel (a) shows a map of one plasmid system used for TadA selection. The vector comprises CAT (H193Y), a sgRNA expression cassette targeting CAT, and an ABE expression cassette. In this figure, N-terminal TadA from *E. coli* and a C-terminal SpCas9 (D10A) from *Streptococcus pyogenes* are shown. Panel (b) shows sequencing traces demonstrating that when introduced/transformed into *E. coli* cells, the A2 position of CAT (H193Y)'s template strand is edited, reverting the H193Y mutant to wild type and restoring its activity. Abbreviations: CAT, chloramphenicol acetyltransferase.

1 µL of plasmid solution with a concentration of 10 ng/L was transformed into 25 µL BL21 (DE3) electrocompetent cells (Lucigen), recovered with 975 µL expression recovery medium at 37° C. for 1 h. 50 L of the resulting cells were spread on a LB agar plate containing 100 µg/mL carbenicillin, 0.1 mM IPTG, and appropriate amount of chloramphenicol. The plate was incubated at 37° C. until colonies were pickable. Colony PCR were used to amplify the genomic region containing base edits, and the resulting products were submitted for Sanger sequencing at ELIM BIOPHARM. Primers used for PCR and sequencing are listed in Table 10 (SEQ ID NOs: 532-537).

TABLE 10

Primers used for base edit analysis of CAT (H193Y)

| Name | SEQ ID NO. | Description | Sequence (5'→3') |
|---|---|---|---|
| P570 | 532 | Forward primer used to amplify CAT (H193Y) of CAT (H193Y)-sgRNA-MG68-4 variant-nSpCas9(D10A) | CCGCCGCCGCAAGGAATGGTTT AATTAATTTGATCGGCACGTAAG AGG |
| P1050 | 534 | Forward primer used to amplify CAT (H193Y) of CAT (H193Y)-sgRNA-MG68-4 variant-nMG34-1(D10A) | AAGGAATGGTTTAATTAATTCTA GATTAATTAATTTGATCGGCACG TAAG |
| P571 | 533 | Reverse primer used to amplify CAT (H193Y) of CAT (H193Y)-sgRNA-MG68-4 variant-nSpCas9 | GGACTGTTGGGCGCCATCTCCTT GCATGCTTCACTTATTCAGGCGT AGCA |
| P571 | 535 | Sanger sequencing primer of CAT (H193Y) | GGACTGTTGGGCGCCATCTCCT TGCATGCTTCACTTATTCAGGCG TAGCA |

Figure 15:
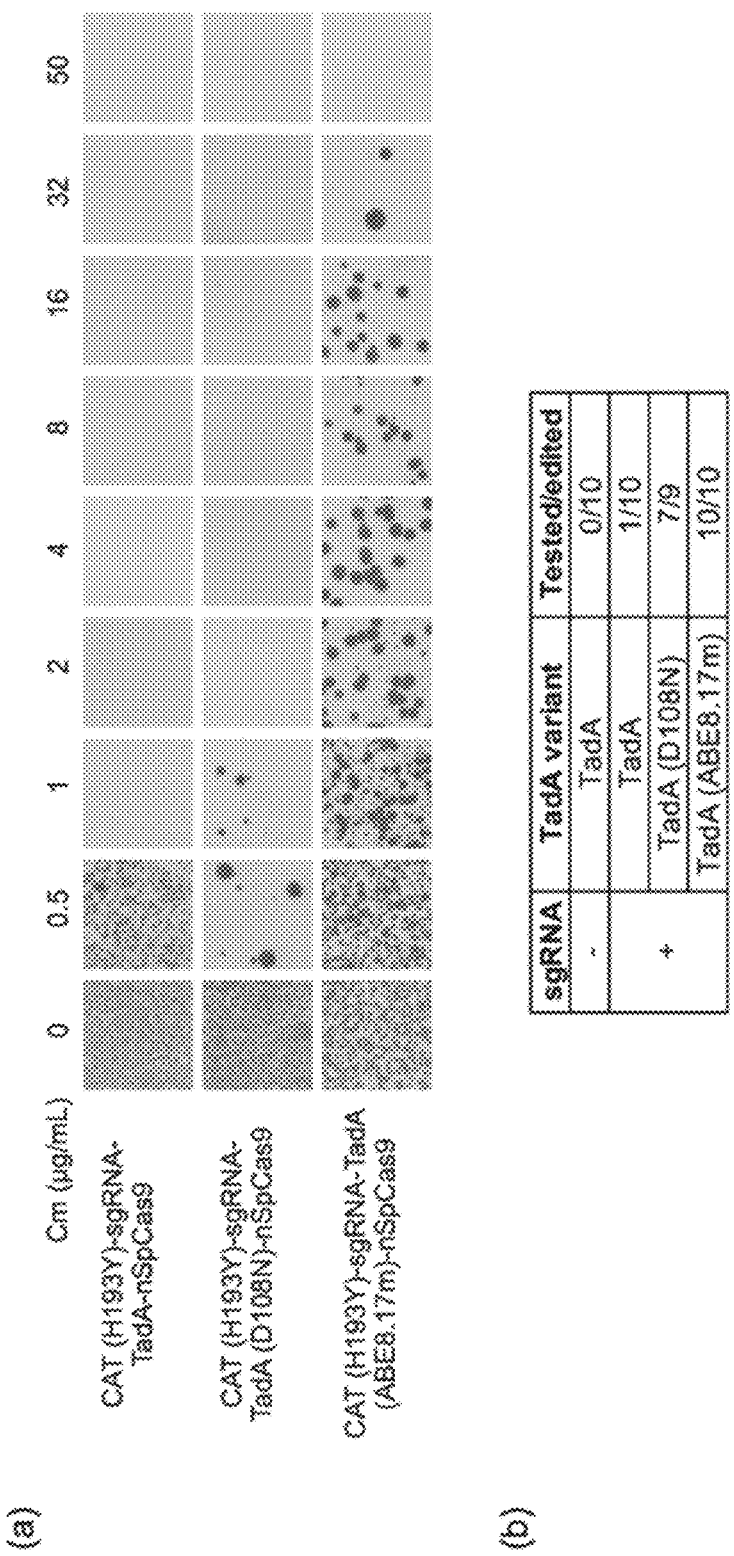
FIG. 15 shows mutations caused by TadA enable high tolerance of chloramphenicol (Cm). Panel (a) shows photographs of growth plates where different concentrations of chloramphenicol were used to select for antibiotics resistance of *E. coli*. In this example, wild type and two variants of TadA from *E. coli* (EcTadA) were tested. Panel (b) shows a results summary table demonstrating that ABEs carrying mutated TadA show higher editing efficiencies than the wild type. In these experiments, colonies were picked from the plates with greater than or equal to 0.5 μg/mL Cm. For simplicity, only identities of deaminases are shown in the table.

FIG. 15 shows mutations caused by TadA enable high tolerance of chloramphenicol (Cm). Panel (a) shows photographs of growth plates where different concentrations of chloramphenicol were used to select for antibiotics resistance of *E. coli*. In this example, wild type and two variants of TadA from *E. coli* (EcTadA) were tested. Panel (b) shows a results summary table demonstrating that ABEs carrying mutated TadA show higher editing efficiencies than the wild type. In these experiments, colonies were picked from the plates with greater than or equal to 0.5 µg/mL Cm. For simplicity, only identities of deaminases are shown in the table, but effectors (SpCas9) and construct organization are shown in the figures above.

Figure 16A:
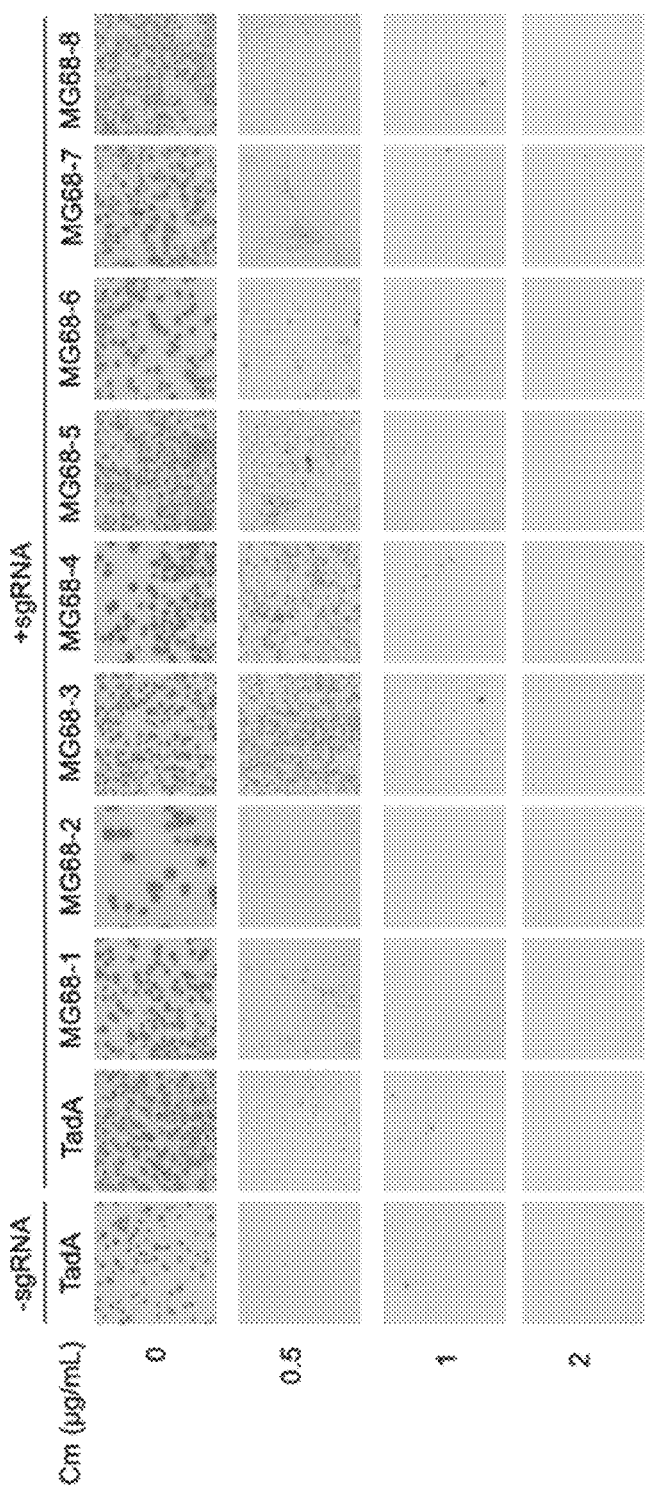
FIG. 16A shows photographs of growth plates to investigate MG TadA activity in positive selection. 8 MG68 TadA candidates were tested against 0 to 2 μg/mL of chloramphenicol (ABEs comprised N-terminal TadA variants and C-terminal SpCas9 (D10A) nickase). For simplicity, only identities of deaminases are shown. In this experiment, colonies were picked from the plates with greater than or equal to 0.5 μg/mL Cm.

FIGS. 16A-16B show investigation of MG TadA activity in positive selection. FIG. 16A shows photographs of growth plates from an experiment where 8 MG68 TadA candidates were tested against 0 to 2 µg/mL of chloramphenicol (ABEs comprised N-terminal TadA variants and C-terminal SpCas9 (D10A) nickase). For simplicity, only identities of deaminases are shown. FIG. 16B shows a summary table depicting editing efficiencies of MG TadA candidates. Panel (b) demonstrates that MG68-3 and MG68-4 drove base edits of adenine. In this experiment, colonies were picked from the plates with greater than or equal to 0.5 µg/mL Cm.

Figure 17:
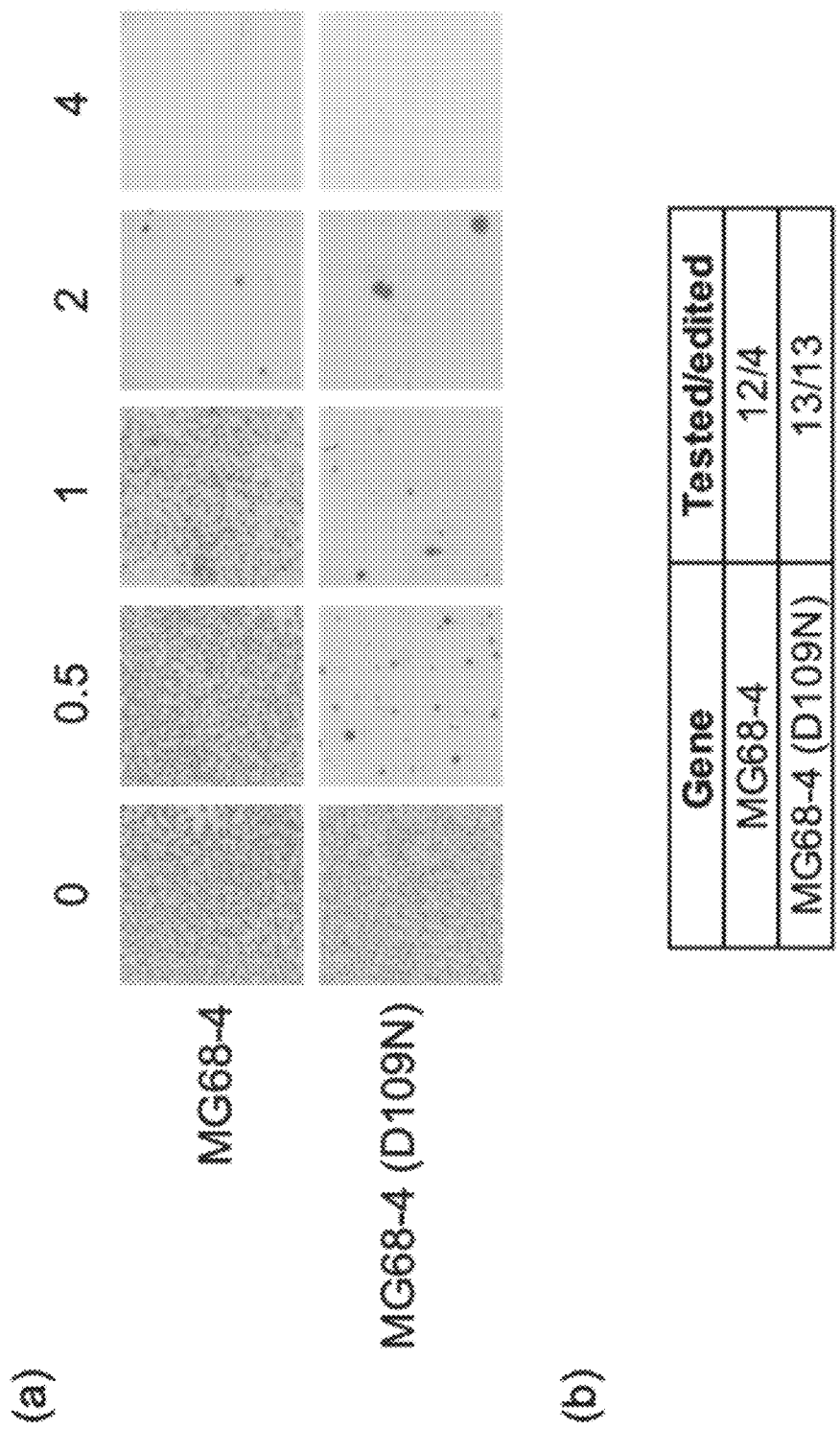
FIG. 17 shows an improvement of base editing efficiency of MG68-4_nSpCas9 via D109N mutation on MG68-4. Panel (a) shows photographs of growth plates where wild type MG68-4 and its variant were tested against 0 to 4 μg/mL of chloramphenicol. For simplicity, only identities of deaminases are shown. Adenine base editors in this experiment are comprise N-terminal TadA variants and C-terminal SpCas9 (D10A) nickase. Panel (b) shows a summary table depicting editing efficiencies of MG TadA candidates. Panel (b) demonstrates thatMG68-4 and MG68-4 (D109N) showed base edits of adenine, with the D109N mutant showing increased activity. In this experiment, colonies were picked from the plates with greater than or equal to 0.5 μg/mL Cm.

FIG. 17 shows an improvement of base editing efficiency of MG68-4_nSpCas9 via D109N mutation on MG68-4. Panel (a) shows photographs of growth plates where wild type MG68-4 and its variant were tested against 0 to 4 µg/mL of chloramphenicol. For simplicity, only identities of deaminases are shown. Adenine base editors in this experiment comprise N-terminal TadA variants and C-terminal SpCas9 (D10A) nickase. Panel (b) shows a summary table depicting editing efficiencies of MG TadA candidates. Panel (b) demonstrates that MG68-4 and MG68-4 (D109N) showed base edits of adenine, with the D109N mutant showing increased activity. In this experiment, colonies were picked from the plates with greater than or equal to 0.5 µg/mL Cm.

Figure 18:
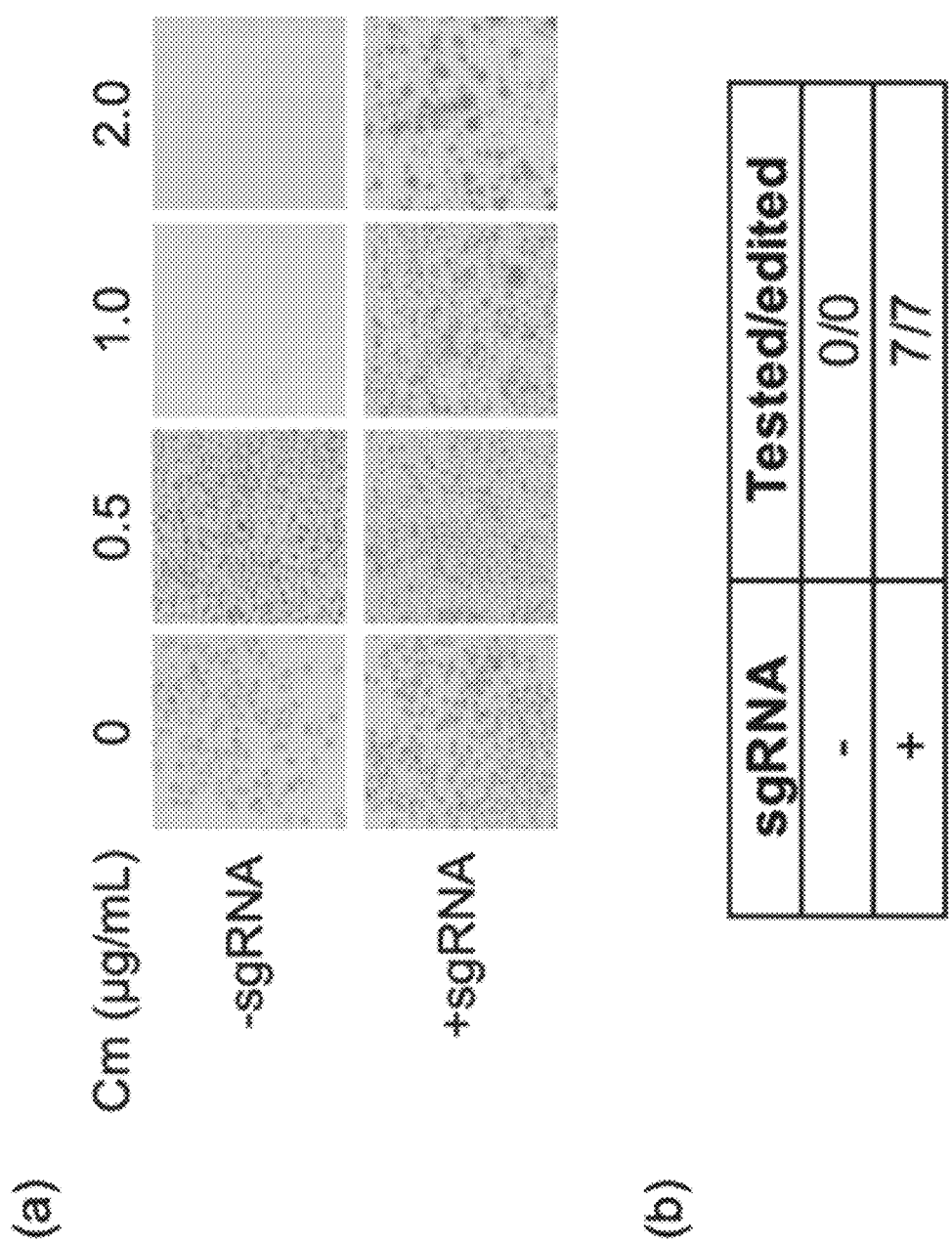
FIG. 18 shows base editing of MG68-4 (D109N)_nMG34-1. Panel (a) shows photographs of growth plates of an experiment where an ABE comprising N-terminal MG68-4 (D109N) and C-terminal MG34-1 nickase was tested against 0 to 2 μg/mL of chloramphenicol. Panel (b) shows a summary table depicting editing efficiencies with and without sgRNA. In this experiment, colonies were picked from the plates with greater than or equal to 1 μg/mL Cm.

FIG. 18 shows base editing of MG68-4 (D109N) _nMG34-1. Panel (a) shows photographs of growth plates of an experiment where an ABE comprising N-terminal MG68-4 (D109N) and C-terminal MG34-1 nickase was tested against 0 to 2 µg/mL of chloramphenicol. Panel (b) shows a summary table depicting editing efficiencies with and without sgRNA. In this experiment, colonies were picked from the plates with greater than or equal to 1 µg/mL Cm.

FIG. 19 shows 28 MG68-4 variants designed for improvements of MG68-4-nMG34-1 base editing activity. 12 residues were selected for targeted mutagenesis to improve editing of the enzymes.

While preferred embodiments of the present invention have been shown and described herein, it will be obvious to those skilled in the art that such embodiments are provided by way of example only. It is not intended that the invention be limited by the specific examples provided within the specification. While the invention has been described with reference to the aforementioned specification, the descriptions and illustrations of the embodiments herein are not meant to be construed in a limiting sense. Numerous variations, changes, and substitutions will now occur to those skilled in the art without departing from the invention. Furthermore, it shall be understood that all aspects of the invention are not limited to the specific depictions, configurations or relative proportions set forth herein which depend upon a variety of conditions and variables. It should be understood that various alternatives to the embodiments of the invention described herein may be employed in practicing the invention. It is therefore contemplated that the invention shall also cover any such alternatives, modifications, variations or equivalents. It is intended that the following claims define the scope of the invention and that methods and structures within the scope of these claims and their equivalents be covered thereby.

SEQUENCE LISTING (694 sequences)

SEQ ID NO: 1 - protein, 186 aa, Unknown
  Description of Unknown: uncultivated organism
  Category: MG66 putative cytidine deaminase
  Description: MG66-2 deaminase
MARVLGLDPGFATCGYALVDLTRKDGAPFVDVRSLGTLRTAKADKKRKVLAADDNLRRAQELIRALYPLASNAQAIVAESMSFPRNSAAAAKMAMCWGIVATLAEMNDLPIVQATPKEIKIAVAGVGTATKEDVAAAVCAKCGRQFSEELLAQGLPKGMHEHAYDAVASVLACLNSDVLRAIRRAG

SEQ ID NO: 2 - protein, 164 aa, Unknown
  Description of Unknown: uncultivated organism
  Category: MG66 putative cytidine deaminase
  Description: MG66-3 deaminase
MDRLSLHQYAIALAWVAATRSEDPYTRVGCVALSEQGNVLATAYNGLKPKATFGPEFWNNRESRLPFMVHAEMNLVSLTKRNEVHTVAINILPCPTCAAFLATHGVQQVVYSEVYHRDKGTVGLTVLREYGVEIHHLPYYRVRPVFLDMDEAHRKVRSEQRTAA

SEQ ID NO: 3 - protein, 135 aa, Unknown
  Description of Unknown: uncultivated organism
  Category: MG66 putative cytidine deaminase
  Description: MG66-4 deaminase
MREYIQAARDEAAKSRCDRAHVGCVIVDRATGHVVSSAFNETPHGLEPCDTGGHRIVDNHCVNTVHAERNAIRKMTEHGSEYTLYVTHYPCQGCAHLIASCPEIVEVVYLGDYNNSSEATALLSGLSKGVHHGEE

SEQ ID NO: 4 - protein, 160 aa, Unknown
  Description of Unknown: uncultivated organism
  Category: MG66 putative cytidine deaminase
  Description: MG66-5 deaminase
MSNTQSLHTTFMHILFEFSKLSHCVSKQVAAMAVKDGRIISTGINGTAPGYTNCDDIFNKSDFNRELHHQFSNTYEIHAEMNMILYAAKNGISLDGATLYCSMLPCWNCIKHISVTGIKHIIYAKRYDMLSLEDEKNIYYYCKKLGITIQQFDPDTLGSF

SEQ ID NO: 5 - protein, 124 aa, Unknown
  Description of Unknown: uncultivated organism
  Category: MG66 putative cytidine deaminase
  Description: MG66-6 deaminase
MTSGILKLALEEAESSTYRFRVGAVVFKGSRILASGHNGIRSSRIHPLHKNYNNALHAEQDAILNVKDWSTLKGCSILVVKVSKTKGTISMAKPCPMCQQLLRHVGIKTMYFSNENGEIISEKL

SEQ ID NO: 6 - protein, 132 aa, Unknown
  Description of Unknown: uncultivated organism
  Category: MG66 putative cytidine deaminase
  Description: MG66-7 deaminase
MTKREIAYFNAAKAVSSLSDHKYKMGCVIVNKHRIISSGFNSETKCHRIQAELDMNEYKMHSSGKVHAETSALLSLRHIDLSKASIFIYRELKDGTKALARPCPCCQKLIRKAGIKHVYYTGNNSLIYEEFI

SEQ ID NO: 7 - protein, 142 aa, Unknown
  Description of Unknown: uncultivated organism
  Category: MG66 putative cytidine deaminase
  Description: MG66-8 deaminase
AAGDFVQVREYIKAARDEAAKSRCDRAHVGCVIVDRVTGRVVSRAFNETPHGLEPCDTGGHRMIDGHCVNTVHAERNAIRKMKEHESEYTLYVTHYPCQGCAHLIASCPEIVEVVYLGDYRNSKEATALLMGLSKGVHRGEE

SEQ ID NO: 8 - protein, 82 aa, Unknown
  Description of Unknown: uncultivated organism
  Category: MG66 putative cytidine deaminase
  Description: MG66-9 deaminase
HRIVDNHCVNTVHAERNAIRKMKEHGSEYTLYVTHYPCQGCAHLISSCPEIVEVVYLGDYRNSSEATALLSGLSKGVHRGEE

SEQ ID NO: 9 - protein, 115 aa, Unknown
  Description of Unknown: uncultivated organism
  Category: MG66 putative cytidine deaminase
  Description: MG66-10 deaminase
HVGCVIVDHATGQVVSSAFNETPPGLEPCDTGGHRIVDDHCVNTVHAERGAIRKMAEHGSEYTLYVTHYPCRGCAHLISSCPEIVEVVYLGDYNNSSEATDLLMSLSKGVHRAEE

SEQ ID NO: 10 - protein, 186 aa, Unknown; identical to SEQ ID NO: 1
  Description of Unknown: uncultivated organism
  Category: MG66 putative cytidine deaminase
  Description: MG66-11 deaminase

SEQ ID NO: 11 - protein, 232 aa, Unknown
  Description of Unknown: uncultivated organism
  Category: MG66 putative cytidine deaminase
  Description: MG66-12 deaminase
MDNLPKYEYLNVLDPERTGISETWLSYFMNIARVIATKSKDPSTKVGAVAVDTNTKRILATGYNGFPAGVKERPERWERPVKYSYIVHSEANIVASAARFGINLTGSTLFVTLHPCVDCAKIVASAGFKNVIYIDTEIKAQVGREWITLLQHSKNIFEESRIGLYACREVPAKKKEEPKLYKTYKGTVETTTELNNKRDKQLGDLVFVKSRNTLYEWNGVIWTVIGEYQHLL

SEQ ID NO: 12 - protein, 113 aa, Unknown
  Description of Unknown: uncultivated organism
  Category: MG66 putative cytidine deaminase
  Description: MG66-13 deaminase
MDNLPKYEYLNVLDPERTRISETWLSYFMNIARVIATKSKDPSTKVGAVAVDTNTKRILATGYNGFPAGVKERPERWERPVKYSYIVHSEANIVASAARFGINLTGSTLFVTL

SEQ ID NO: 13 - protein, 232 aa, Unknown
  Description of Unknown: uncultivated organism
  Category: MG66 putative cytidine deaminase
  Description: MG66-14 deaminase
MDNLPKYEYLNVLDPERTRISETWLSYFMNIARVIATKSKDPSTKVGAVAVDTNTKRILATGYNGFPAGVKERPERWERPVKYSYIVHSEANIVASAARFGINLTGSTLFVTLHPCVDCAKIVASAGFKNVIYIDTEIKPQVGREWITLLQHSKNIFEESRIGLYACREVPAKKKEEPKLYKTFKGTVETTVELNNKRDKQLGDLVFVKSRNTLYEWNGVIWTVIGEYQHLL

SEQ ID NO: 14 - protein, 164 aa, Unknown; identical to SEQ ID NO: 2
  Description of Unknown: uncultivated organism
  Category: MG66 putative cytidine deaminase
  Description: MG66-15 deaminase

SEQ ID NO: 15 - protein, 50 aa, Unknown
  Description of Unknown: uncultivated organism
  Category: MG66 putative cytidine deaminase
  Description: MG66-18 deaminase
MKQYIQAARDEAAKSRCDRAHVGCVIVDRATGQVVSRAFNETPHGLEPCD

SEQ ID NO: 16 - protein, 135 aa, Unknown
  Description of Unknown: uncultivated organism
  Category: MG66 putative cytidine deaminase
  Description: MG66-19 deaminase
MKQYIQAARDEAAKSRCDRAHVGCVIVDRATGQVVSRAFNETPHGLEPCDTGGHRIVDNHCVNTVHAERNAIRKMKEHGSEYTLYVTHYPCQGCAHLISSCPEIVEVVYLGDYRNSSEATALLSGLSKGVHRGEE

SEQ ID NO: 17 - protein, 135 aa, Unknown
  Description of Unknown: uncultivated organism
  Category: MG66 putative cytidine deaminase
  Description: MG66-20 deaminase
MKQYIQAARDEAAKSRCDRAHVGCVIVDRATGQVVSRAFNETPHGLEPCDTGGHRIVDNHCVNTVHAERNAIRQMKEHGSEYTLYVTHYPCQGCAHLISSCPEIIEVVYIGDYNNSSEATALLSGLSKGVHRGEE

SEQ ID NO: 18 - protein, 204 aa, Unknown
  Description of Unknown: uncultivated organism
  Category: MG66 putative cytidine deaminase
  Description: MG66-21 deaminase
MNIARVIATKSKDPSTKVGAVAVDTNTKRILATGYNGFPAGVKERPERWERPVKYSYIVHSEANIVASAARFGINLTGSTLFVTLHPCVDCAKIVASAGFKNVIYIDTEIKPQVGREWITLLQHSKNIFEESRIGLYACREVPAKKKEEPKLYKTFKGTVETTVELNNKRDKQLGDLIFVRSRNTLYEWNGVIWTVIGEYQHLL

SEQ ID NO: 19 - protein, 142 aa, Unknown
  Description of Unknown: uncultivated organism
  Category: MG66 putative cytidine deaminase
  Description: MG66-22 deaminase
MREFIKAARDEAAKSRCDRAHVGCVIVDRATGRVVSRAFNETPHGLEPCDTGGHRMIDGHCVNTVHAERGAIRKMQSHDSEYTLYVTHYPCQGCAHLIASCPDIVEVVYLGDYRNSNEATALLMGLSKGVHHAEEDCSSSPA

SEQ ID NO: 20 - protein, 142 aa, Unknown
  Description of Unknown: uncultivated organism
  Category: MG66 putative cytidine deaminase
  Description: MG66-23 deaminase
MREFIKAARDEAAKSRCDRAHVGCVIVDRATGRVVSRAFNETPHGLEPCDTGGHRMIDGHCVNTVHAERGAIRKMQSHDSEYTLYVTHYPCQGCAHLIASCPEIVEVVYLGDYRNSNEATALLMGLSKGVHHAEEDCSSSPA

SEQ ID NO: 21 - protein, 142 aa, Unknown
  Description of Unknown: uncultivated organism
  Category: MG66 putative cytidine deaminase
  Description: MG66-24 deaminase
MREFIKAARDEAAKSRCDRAHVGCVIVDRATGRVVSRAFNETPHGLEPCDTGGHRMIDGHCVNTVHAERGAIRKMQTHDSEYTLYVTHYPCQGCAHLIASCPEIVEVVYLGDYRNSNEATALLMGLSKGVHHAEEDCSSSPA

SEQ ID NO: 22 - protein, 142 aa, Unknown
  Description of Unknown: uncultivated organism
  Category: MG66 putative cytidine deaminase
  Description: MG66-25 deaminase
MREFIKAARDEAAKSRCDRAHVGCVIVDRATGRVVSRAFNETPHGLEPCDTGGHRMIDGHCVNTVHAERGAIRKMTSHDSEYTLYVTHYPCQGCAHLIASCPEIVEVVYLGDYRNSNEATALLMGLSKGVHHAEEDCSSSPA

SEQ ID NO: 23 - protein, 136 aa, Unknown
  Description of Unknown: uncultivated organism
  Category: MG66 putative cytidine deaminase
  Description: MG66-26 deaminase
MRELGIKAARDEAKKSRCDRAHVGCVIIDRASGQVVSRAFNETPPTLEPCDTGGHRMVDGHCVNTVHAERGAIRKMAEHGSEYTLYVTHYPCRGCAHLISSCPEIVEVVYLGDYNNSSEATALLMSLSKGVHRVKG

SEQ ID NO: 24 - protein, 135 aa, Unknown
  Description of Unknown: uncultivated organism
  Category: MG66 putative cytidine deaminase
  Description: MG66-27 deaminase
MREYIKAARDEAAKSRCDRAHVGCVIVDHATGQVVSRAFNETPHGLEPCDTGGHRIVDNHCVNTVHAERNAIRKMKEHGSEYTLYVTHYPCRGCAHLISTCPEIVEVVYLGDYNNSSEATALLEGLSKGVHRGEE

SEQ ID NO: 25 - protein, 135 aa, Unknown
  Description of Unknown: uncultivated organism
  Category: MG66 putative cytidine deaminase
  Description: MG66-28 deaminase
MREYIKAARDEAAKSRCDRAHVGCVIVDRATEQVVSRAFNETPNGLEPCDTGGHRIVDDHCVNTVHAERNAIRKMREHGSEYTLYVTHYPCQGCAHLISSCPEIVEVVYLGDYNNSSEATALLSGLSKGVHRGEE

SEQ ID NO: 26 - protein, 36 aa, Unknown
  Description of Unknown: uncultivated organism
  Category: MG66 putative cytidine deaminase
  Description: MG66-29 deaminase
MREYIKAARDEAAKSRCDRAHVGCVIVDRATGQVVS

SEQ ID NO: 27 - protein, 135 aa, Unknown
  Description of Unknown: uncultivated organism
  Category: MG66 putative cytidine deaminase
  Description: MG66-30 deaminase
MREYIKAARDEAAKSRCDRAHVGCVIVDRATGQVVSGAFNETPHGLEPCDTGGHRIVDGHCVNTVHAERNAIRKMKEHGSEYTLYVTHYPCRGCAHLISSCPEIVEVVYLGDYNNSSEATALLSGLSKGVHRGEE

SEQ ID NO: 28 - protein, 135 aa, Unknown
  Description of Unknown: uncultivated organism
  Category: MG66 putative cytidine deaminase
  Description: MG66-31 deaminase
MREYIKAARDEAAKSRCDRAHVGCVIVDRATGQVVSRAFNETPHGLEPCDTGGHRIVDNHCVNTVHAERNAIRKMKEHGSEYTLYVTHYPCQGCAHLISSCPEIVEVVYLGDYRNSSEATALLSGLSKGVHRGEE

SEQ ID NO: 29 - protein, 135 aa, Unknown
  Description of Unknown: uncultivated organism
  Category: MG66 putative cytidine deaminase
  Description: MG66-32 deaminase
MREYIKAARDEAAKSRCDRAHVGCVIVDRATGQVVSRAFNETPHGLEPCDTGGHRIVDNHCVNTVHAERNAIRKMTDHGSEYTLYVTHYPCQGCAHLISSCPEIVEVVYLGDYNNSSEATALLSGLSKGVHRGEE

SEQ ID NO: 30 - protein, 135 aa, Unknown
  Description of Unknown: uncultivated organism
  Category: MG66 putative cytidine deaminase
  Description: MG66-33 deaminase
MREYIKAARDEAAKSRCDRAHVGCVIVDRATGQVVSRAFNETPHGLEPCDTGGHRMVDDHCVNTIHAERNAIRQMKEHGSEYTLYVTHYPCRGCAHFISTCPEIVEVVYLGDYRNSSEATALLSGLSKGVHRGEE

SEQ ID NO: 31 - protein, 40 aa, Unknown
  Description of Unknown: uncultivated organism
  Category: MG66 putative cytidine deaminase
  Description: MG66-34 deaminase
MREYIKAARDEAAKSRCDRAHVGCVIVDRATGQVVSSAFN

SEQ ID NO: 32 - protein, 135 aa, Unknown
  Description of Unknown: uncultivated organism
  Category: MG66 putative cytidine deaminase
  Description: MG66-35 deaminase
MREYIKAARDEAAKSRCDRAHVGCVIVDRATGQVVSSAFNETPHGLEPCDTGGHRIVDNHCVNTVHAERNAIRQMTDHGSEYTLYVTHYPCQGCAHLIASCPEIVEVVYLGDYNNSSEATALLSGLSKGVHRGEE

SEQ ID NO: 33 - protein, 142 aa, Unknown
  Description of Unknown: uncultivated organism
  Category: MG66 putative cytidine deaminase
  Description: MG66-36 deaminase
MREYIKAARDEAAKSRCDRAHVGCVIVDRATGRVVSRAFNETPHGLEPCDTGGHRMIDGHCVNTVHAERNAIRKMPSHDSEYTLYVTHYPCQGCAHLIASCPDIVEVVYLGDYRNSEEATALLMGLSKGIHCAEEDRSSSPA

SEQ ID NO: 34 - protein, 142 aa, Unknown
  Description of Unknown: uncultivated organism
  Category: MG66 putative cytidine deaminase
  Description: MG66-37 deaminase
MREYIKAARDEAAKSRCDRAHVGCVIVDRATGRVVSRAFNETPHGLEPCDTGGHRMIDGHCVNTVHAERNAIRKMPSHDSEYTLYVTHYPCQGCAHLIASCPDIVEVVYLGDYRNSEEATALLMGLSKGVHCAEEDRSSSPA

SEQ ID NO: 35 - protein, 135 aa, Unknown
  Description of Unknown: uncultivated organism
  Category: MG66 putative cytidine deaminase
  Description: MG66-38 deaminase
MREYIKAARDEAKKSRCDRAHVGCVIVDRASGQVVSSAFNETPPGLEPCDTGGHRMVDDHCVNTVHAERGAILKMAEHGSEYTLYVTHYPCRGCAHLISSCPEIVEVVYLGDYNNSSEATTLLMSLSKGVHHVEG

SEQ ID NO: 36 - protein, 135 aa, Unknown
  Description of Unknown: uncultivated organism
  Category: MG66 putative cytidine deaminase
  Description: MG66-39 deaminase
MREYIKAARDEAKKSRCDRAHVGCVIVDRATGQVVSKGFNETPPGLEPCDTGGHHIVDNHCVNTVHAERSAIRKMTEHGSEYTLYVTHYPCRGCAHLITSCPEIMEVVYLGDYNNSSEATELLMGLSKGVHHVEG

SEQ ID NO: 37 - protein, 135 aa, Unknown
  Description of Unknown: uncultivated organism
  Category: MG66 putative cytidine deaminase
  Description: MG66-40 deaminase
MREYIKAARDEAKKSRCDRAHVGCVIVDRATGRVVSRAFNETPHGLEPCDTGGHRIVDDHCVNTVHAERNAIRRMVEHGSEYTLYVTHYPCQGCAHLISSCPEIVEVVYLGDYNNSSEATALLSGLSKGVHRGEE

SEQ ID NO: 38 - protein, 135 aa, Unknown
  Description of Unknown: uncultivated organism
  Category: MG66 putative cytidine deaminase
  Description: MG66-41 deaminase
MREYIQAARDEAKKSRCDRAHVGCVIVDRASGQVVSSAFNETPPGLEPCDTGGHRMVDGHCVNTVHAERGAIRKMAEHGSEYTLYVTHYPCRGCAHLISSCPEIMEVVYLGDYNNSSEATTLLMGLSKGVHHVEE

SEQ ID NO: 39 - protein, 135 aa, Unknown
  Description of Unknown: uncultivated organism
  Category: MG66 putative cytidine deaminase
  Description: MG66-42 deaminase
MREYIQAARDEAKKSRCDRAHVGCVIVDRATGRVVSSAFNETPPGLEPCDTGGHRMVDGHCVNTVHAERGAIRKMAEHGSEYTLYVTHYPCRGCGHLISSCPEIVEVVYLGDYNNSSEATALLMGLSKGVHHVEE

SEQ ID NO: 40 - protein, 135 aa, Unknown
  Description of Unknown: uncultivated organism
  Category: MG66 putative cytidine deaminase
  Description: MG66-43 deaminase
MREYIQAARDEASKSRCDRAHVGCVIVDRATGQVVSRAFNETPHGLEPCDTGGHRIVDNHCVNTIHAERNAIRKMPTHDSEYTLYVTHYPCQGCAHLISSCPEIVEVVYLGDYRNSSEATALLSGLSKGVHRGEE

SEQ ID NO: 41 - protein, 135 aa, Unknown
  Description of Unknown: uncultivated organism
  Category: MG66 putative cytidine deaminase
  Description: MG66-44 deaminase
MREYIRAARDEAAKSRCDRAHVGCVIVDRATGQVVSRAFNETPHGLEPCDTGGHRIVDNHCVNTVHAERNAIRKMTEHGSEYTLYVTHYPCQGCAHLISSCPEIVEVVYLGDYNNSSEATALLEGLSKGVHRGEE

SEQ ID NO: 42 - protein, 135 aa, Unknown
  Description of Unknown: uncultivated organism
  Category: MG66 putative cytidine deaminase
  Description: MG66-45 deaminase
MREYIRAARDEAAKSRCDRAHVGCVIVDRATSRVVSRAFNETPHGLDPCDTGGHRMIDGHCVNTVHAERNAIRKMPSHDSEYTLYVTHYPCQGCAHLIASCPDIVEVVYLGDYRNSKEATALLMGLSKGIHHAEE

SEQ ID NO: 43 - protein, 151 aa, Unknown
  Description of Unknown: uncultivated organism
  Category: MG66 putative cytidine deaminase
  Description: MG66-46 deaminase
MRVRPDWDTYFMRIAKVVAQRSHDEDTQVGCVIVSPDKRILSTGYNGFPPGFPDGKLPRTRPGKYPYIVHSEINAIVSALNRDLRGATLYCRFTPCKDCVKAIITAGITRIVYEETYARDNTDAAVVFEMLEMGGVEIVKHLEHEHEADSD

SEQ ID NO: 44 - protein, 159 aa, Unknown
  Description of Unknown: uncultivated organism
  Category: MG66 putative cytidine deaminase
  Description: MG66-47 deaminase
MSNTQSLHTTFMHILFEFSKLSHCVSKQVAAMAVKDGRIISTGINGTAPGYTNCDDIFNKSDFDRELHHQFSNTYEIHAEMNMILYAAKNGISLDGATLYCSMLPCWNCIKHISVTGIKHIIYAKRYDMLSLEDEKNIYYYCKKLGITIQQFDPDTLGS

SEQ ID NO: 45 - protein, 160 aa, Unknown
  Description of Unknown: uncultivated organism
  Category: MG66 putative cytidine deaminase
  Description: MG66-48 deaminase
MSNTQSLHTTFMHILFEFSKLSHCVSKQVAAMAVKDGRIISTGINGTAPGYTNCDDIFNKSDFDRELHHQFSNTYEIHAEMNMILYAAKNGISLDGATLYCSMLPCWNCIKHISVTGIKHIIYAKRYDMLSLEDEKNIYYYCKKLGITIQQFDPDTLGSF

SEQ ID NO: 46 - protein, 124 aa, Unknown; identical to SEQ ID NO: 5
  Description of Unknown: uncultivated organism
  Category: MG66 putative cytidine deaminase
  Description: MG66-49 deaminase

SEQ ID NO: 47 - protein, 80 aa, Unknown
  Description of Unknown: uncultivated organism
  Category: MG66 putative cytidine deaminase
  Description: MG66-50 deaminase
MVDGHCVNTVHAERGAIRKMTEHGSEYTLYVTHYPCRGCAHLISSCPEIVEVVYLGDYNNSSEATALLMGLSKGVHHVEG

SEQ ID NO: 48 - protein, 150 aa, Unknown
  Description of Unknown: uncultivated organism
  Category: MG67 putative cytidine deaminase
  Description: MG67-2 deaminase
MTACKDKPVCNVAQADATLLSTCLRLLQTAHEIKQNAYAPYSGFQVGAAVLAKNGSIITGVNVENGSLGLTICAERTALSKAVSEGYRPGDFVAIAVAASADGFSPCGACREVINEFGQNMLVVFEYQDEVVVAPLKTLLAYNFVKGKPS

SEQ ID NO: 49 - protein, 62 aa, Unknown
  Description of Unknown: uncultivated organism
  Category: MG67 putative cytdidine deaminase
  Description: MG67-4 deaminase
MAYRPGDFVAIAIAASSPDFSPCGACREVINEFGDDMAVIFEIKGETVVSQLKEHLPYNFKM

SEQ ID NO: 50 - protein, 250 aa, Unknown
  Description of Unknown: uncultivated organism
  Category: MG68 putative adenosine deaminase (TadA-like)
  Description: MG68-1 deaminase
MQHVKHMRTAVRLARYALDHDETPVACIFVHTPTGQVMAYGMNDTNKSLTGVAHAEFMGIDQIKAMLGSRGVVDVFKDITLYVTVEPCIMCASALKQLGIGKVVFGCGNERFGGNGTVLSVNHDTCTLVPKNNSAAGYESIPGILRKEAIMLLRYFYVRQNERAPKPRSKSDRVLDKNTFPPMEWSKYLNEEAFIETFGDDYKTCFANKVDLSSNSVDWDLIDSHQDNIIQELEEQCKMFRFNVHKKSKV

SEQ ID NO: 51 - protein, 239 aa, Unknown
  Description of Unknown: uncultivated organism
  Category: MG68 putative adenosine deaminase (TadA-like)
  Description: MG68-2 deaminase
MLLNKRSYGHFYFIALMTEFSKWDEYYMKLALMEAEKALNSNEVPIGCVFVKSDTEVEIPPLPSRYSKDEFHSSVIASGRNFTNENYNATHHAEIMALTDLISCLECNCKKIDNMGEPCKPTFSKDTECPQCNFNLKNVTLYVTIEPCIMCISALMELQVSRIVFGANNDKFGGCGGTLTNVPEILKDTCSKDFEEIKIERGLYREEAVILLRKFYLIQNPKAPNPKKKAKRTLNLIVD

SEQ ID NO: 52 - protein, 87 aa, Unknown
  Description of Unknown: uncultivated organism
  Category: MG69 UGI
  Description: MG69-1 deaminase
MSKTIKDLEEFAAEKLGYDIVFQESISMEPQEVEHLITTDEKSVLVNSTYDDNKEITISMISTPHPEYRPIALIIQDMEGEVQRKEL

SEQ ID NO: 53 - protein, 88 aa, Unknown
  Description of Unknown: uncultivated organism
  Category: MG69 UGI
  Description: MG69-2 deaminase
MSKTIKDLEEFAAEKLGYDIVFQESISMEPQEVEHLITTDEKSVLVNSTYDDDKEITISVISTPHPEYRPIALVIQDMEGEVQRKELY

SEQ ID NO: 54 - protein, 84 aa, Unknown
  Description of Unknown: uncultivated organism
  Category: MG69 UGI
  Description: MG69-3 deaminase
MTNLSDIIEKETGKQLVIQESILMLPEEVEEVIGNKPESDILVHTAYDESTDENVMLLTSDAPEYKPWALVIQDSNGENKIKML

SEQ ID NO: 55 - protein, 67 aa, Unknown
  Description of Unknown: uncultivated organism
  Category: MG69 UGI
  Description: MG69-4 deaminase
MIVRVTYNVEQEVEISNKFNKDVDIMKPEEYDDYIDDLMFALNEKLPEYAEISCVINDNTGEVLFEG

SEQ ID NO: 56 - protein, 35 aa, Unknown
  Description of Unknown: uncultivated organism
  Category: MG69 UGI
  Description: MG69-5 deaminase
MSKTIKDLEEFAAEKLGYDIVFQESISMEPQEVEH

SEQ ID NO: 57 - protein, 167 aa, Escherichia coli
  Category: reference deaminase
  Description: P68398 TADA tRNA specific adenosine deaminase
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 58 - protein, 229 aa, Rattus norvegicus [sequence omitted]

SEQ ID NO: 59 - protein, 251 aa, Heterocephalus glaber
  Category: reference deaminase
  Description: Aicda XM 004869540 cytidine deaminase
MAVGSKPKAALVGPHWERERIWCFLCSTGLGTQQTGQTSRWLRPAATQDPVSPPRSLLMKQRKFLYHFKNVRWAKGRHETYLCYVVKRRDSATSFSLDFGYLRNKSGCHVELLFLRYISDWDLDPGRCYRVTWFTSWSPCYDCARHVADFLRGNPNLSLRIFTARLYFCEDRKAEPEGLRRLHRAGVQIAIMTFKDYFYCWNTFVENHERTFKAWEGLHENSVRLSRQLRRILLPLYEVDDLRDAFRTLGL

SEQ ID NO: 60 - protein, 224 aa, Petromyzon marinus
  Category: reference deaminase
  Description: PmCDA1 L1 AVN88313.1 cytidine deaminase
MAGYECVRVSEKLDFDTFEFQFENLHYATERHRTYVIFDVKPQSAGGRSRRLWGYIINNPNVCHAELILMSMIDRHLESNPGVYAMTWYMSWSPCANCSSKLNPWLKNLLEEQGHTLTMHFSRIYDRDREGDHRGLRGLKHVSNSFRMGVVGRAEVKECLAEYVEASRRTLTWLDTTESMAAKMRRKLFCILVRCAGMRESGIPLHLFTLQTPLLSGRVVWWRV

SEQ ID NO: 61 - protein, 208 aa, Petromyzon marinus
  Category: reference deaminase
  Description: PmCDA1 ABO15149.1 cytosine deaminase
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAV

SEQ ID NO: 62 - protein, 199 aa, Homo sapiens
  Category: reference deaminase
  Description: NP 663745.1 DNA dC- dU-editing deaminase APOBEC-3A isoform a
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 63 - protein, 198 aa, Homo sapiens [sequence omitted]

SEQ ID NO: 64 - protein, 197 aa, Lampetra planeri
  Category: reference deaminase
  Description: LpCDA1L1 3 AVN88320.1 cytidine deaminase
MAGDENVRVSEKLHFNTFEFEFENLHYAEGRGQTYVIFDVKPQSEGGRGERLWGYVRNKPLGDHAEVILMSKINDHLETHQDNYTMTWYMSWSPCGKCSSELVPWLQNLLKKQHKLTMHFSRIYDKDRAVDHRGLCDLQHVVSNGFQMGVMGQTEVDTCLAEYVEASGCPPLKWLHMTDSNATQMQDKLSSILMNRF

SEQ ID NO: 65 - protein, 198 aa, Lampetra planeri
  Category: reference deaminase
  Description: LpCDA1L1 1 AVN88319.1 cytidine deaminase
MAGDENVRVSKKLDFNTFEFEFENLHYAEGRGRTYVIFDVKPQSEGGRGERLWGYVRNNPLDDHAEVILMSKINDHLETHQGNYTMTWYMSWSPCGNCSSELVPWLQNLLEEQQHTLTMYFSRIYDKDRAVDHRGLCDLQHVVSNGFQMGVMGQTEVDTCLAEYVEASGCPPLKWLHMTDSNATQTQDKLSSILMNRF

SEQ ID NO: 66 - DNA, 642 bp, Lampetra planeri
  Category: reference deaminase
  Description: ljCDA1 cytidine deaminase
gccaacgccgagtacgtgcgcgtgggcgagaagctggacagctgcaccttccgcacccagttcctgaactaccgccgcagccgcagccgccgctgctgcgtgatcttcgagctgaagcgccagaacagccgcgtgcgcttctggggctacgccatgaacaagccctggagcaacgccgacgtgggcatccacgccgagttcttctgcatcaagaaggtgaagaagtacctgcgcaagaaccccggcatctacaccatcaactggtacagcagctggagcccctgcgccaactgcgccgagaagatcctgaactggtacaacaagaagctgatgggcaagggccacaccctgaagatttgggcctgcaagctgtacttcgagaacatcaagcgcaaccagatcggcctgtggaacctgcgcaacaacggcgtgggcctggccatcatgctgggcgagcactaccagtggtgctggaacaactacatccagaccctgggccgcaacctgaacgagaacaagtggctgaaaaagaccagcaaccgcgcccgcacccgccgcagcgagctgagcatcatgatccacgtgaagcgcctgcacaccgcccgcctgctgctgttcaagcgcctgtgcggctggttcagc

SEQ ID NO: 67 - protein, 84 aa, Unknown; identical to SEQ ID NO: 54
  Description of Unknown: Bacillus phage PBS2 sequence
  Category: reference UGI
  Description: P14739 UNGI BPPB2 (UGI)

SEQ ID NO: 68 - protein, 1245 aa, Artificial Sequence
  Description of Artificial Sequence: Synthetic polypeptide
  Category: adenine base editor
  Description: linker-His tag-adenine deaminse-linker-nickase -linker-SV40 NLS
MGSSHHHHHHSEVEFSHEYWMRHALTLAKRARDEREVPVGAVLVLNNRVIGEGWNRAIGLHDPTAHAEIMALRQGGLVMQNYRLIDATLYSTFEPCVMCAGAMIHSRIGRVVFGVRNAKTGAAGSLMDVLHYPGMNHRVEITEGILADECAALLCYFFRMPRRVFNAQKKAQSSTDSGGSSGGSSGSETPGTSESATPESSGGSSGGSMKKKVFAFALGKASIGYCVRDGFNINEANSIIIDKDHAETMSLRDRRRIKKTLDAHHAREEYFNKVWSGVGLNILDKNNNNFKKEFPSKNEDVIYTSCLLRIALLQNQKLEEWQIYKALYNAFQRRGYDVNIAWKSVQTDDDKENIERMKKYTCENDIELIISDEYKYPCYYDALRLGLWNEDEPTKLNRSIPQHNSNKVRTTEYVAPRELVEKELKQLWLNAQLQLPQLNSISAEEFLYGEYKIPYGSCVQKEFKQYRGTKKDWQGVLCQKIPRFDNRIIAKCKLLPKRNVCKANTIENVSFVLLMKLKNLRFTVISGEKLRLSPVQIKQIYENWLEKVEDTYNKDLEKAEKLGKENPEKRLNITITRQEIEKIIGEKIIDKIEPMKADISGRSSFCRRACQIMNKIILDGELYPQNVDISEFVDRDNAKNGITEEEIQSMLSKIGDWNNLYIPDNREENAQNASNSRIKTDIMLGNITNPIVRNRLQIFRDLLLNLAEKYGTPDEVIFEFVRDGADNSLYGSKKAQDTERFMKQQEKENEQIINELKDAGLYVNGQNHANATYFLMHKLLKSQGGKCIYSGQNISPSNYDECEIDHIYPRTLGGNDALYNKVVCYRRENQDKKGRTPYEWLSPDSDKWANYVNRLNKIKKQLGKKKFELLTSKPEDCEKLIESYNGLAETSHIARVAQQMTAFIFGWGLQIQGESRRIFVNNGSSTCAIRKRYGLNKLLGDNLKKNRSNDKHHALDAICISFSRDFKYDKEIKKDIIKGFNPEIVKNAIDKIMPYPYANDKPFKGNTKPLETIYGLRTYGDKSYITQRVELNSIDKKATKIKSIIDETIKNDLLNKLKENPTEQEWKLMLQNYIHPKKQTKVKKVMISVSEGEITKDSNNRERMGEFVDFGTKGTQHQFKHSKRHKGQILYFNEKGVVEVMPVYSNIKTTDVKDKLQNMGCKLYNKGQMFYSGCLVDIPKPFKAGSKEYPAGRYQIKTIRSDKVAELEDACGNKISTNVKYLVPAEFKKVESKGSGGSPKKKRKV

SEQ ID NO: 69 - protein, 1380 aa, Artificial Sequence
  Description of Artificial Sequence: Synthetic polypeptide
  Category: cytosine base editor
  Description: linker-His tag-cytidine deaminase-linker-nickase -linker-uracil glycosylase inhibitor-linker-SV40 NLS
MGSSHHHHHHMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESAMKKKVFAFALGKASIGYCVRDGFNINEANSIIIDKDHAETMSLRDRRRIKKTLDAHHAREEYFNKVWSGVGLNILDKNNNNFKKEFPSKNEDVIYTSCLLRIALLQNQKLEEWQIYKALYNAFQRRGYDVNIAWKSVQTDDDKENIERMKKYTCENDIELIISDEYKYPCYYDALRLGLWNEDEPTKLNRSIPQHNSNKVRTTEYVAPRELVEKELKQLWLNAQLQLPQLNSISAEEFLYGEYKIPYGSCVQKEFKQYRGTKKDWQGVLCQKIPRFDNRIIAKCKLLPKRNVCKANTIENVSFVLLMKLKNLRFTVISGEKLRLSPVQIKQIYENWLEKVEDTYNKDLEKAEKLGKENPEKRLNITITRQEIEKIIGEKIIDKIEPMKADISGRSSFCRRACQIMNKIILDGELYPQNVDISEFVDRDNAKNGITEEEIQSMLSKIGDWNNLYIPDNREENAQNASNSRIKTDIMLGNITNPIVRNRLQIFRDLLLNLAEKYGTPDEVIFEFVRDGADNSLYGSKKAQDTERFMKQQEKENEQIINELKDAGLYVNGQNHANATYFLMHKLLKSQGGKCIYSGQNISPSNYDECEIDHIYPRTLGGNDALYNKVVCYRRENQDKKGRTPYEWLSPDSDKWANYVNRLNKIKKQLGKKKFELLTSKPEDCEKLIESYNGLAETSHIARVAQQMTAFIFGWGLQIQGESRRIFVNNGSSTCAIRKRYGLNKLLGDNLKKNRSNDKHHALDAICISFSRDFKYDKEIKKDIIKGFNPEIVKNAIDKIMPYPYANDKPFKGNTKPLETIYGLRTYGDKSYITQRVELNSIDKKATKIKSIIDETIKNDLLNKLKENPTEQEWKLMLQNYIHPKKQTKVKKVMISVSEGEITKDSNNRERMGEFVDFGTKGTQHQFKHSKRHKGQILYFNEKGVVEVMPVYSNIKTTDVKDKLQNMGCKLYNKGQMFYSGCLVDIPKPFKAGSKEYPAGRYQIKTIRSDKVAELEDACGNKISTNVKYLVPAEFKKVESKGSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 70 - protein, 1025 aa, Artificial Sequence
  Description of Artificial Sequence: Synthetic polypeptide
  Category: nickase
  Description: nMG1-4 (D9A) nickase
MKKKVFAFALGKASIGYCVRDGFNINEANSIIIDKDHAETMSLRDRRRIKKTLDAHHAREEYFNKVWSGVGLNILDKNNNNFKKEFPSKNEDVIYTSCLLRIALLQNQKLEEWQIYKALYNAFQRRGYDVNIAWKSVQTDDDKENIERMKKYTCENDIELIISDEYKYPCYYDALRLGLWNEDEPTKLNRSIPQHNSNKVRTTEYVAPRELVEKELKQLWLNAQLQLPQLNSISAEEFLYGEYKIPYGSCVQKEFKQYRGTKKDWQGVLCQKIPRFDNRIIAKCKLLPKRNVCKANTIENVSFVLLMKLKNLRFTVISGEKLRLSPVQIKQIYENWLEKVEDTYNKDLEKAEKLGKENPEKRLNITITRQEIEKIIGEKIIDKIEPMKADISGRSSFCRRACQIMNKIILDGELYPQNVDISEFVDRDNAKNGITEEEIQSMLSKIGDWNNLYIPDNREENAQNASNSRIKTDIMLGNITNPIVRNRLQIFRDLLLNLAEKYGTPDEVIFEFVRDGADNSLYGSKKAQDTERFMKQQEKENEQIINELKDAGLYVNGQNHANATYFLMHKLLKSQGGKCIYSGQNISPSNYDECEIDHIYPRTLGGNDALYNKVVCYRRENQDKKGRTPYEWLSPDSDKWANYVNRLNKIKKQLGKKKFELLTSKPEDCEKLIESYNGLAETSHIARVAQQMTAFIFGWGLQIQGESRRIFVNNGSSTCAIRKRYGLNKLLGDNLKKNRSNDKHHALDAICISFSRDFKYDKEIKKDIIKGFNPEIVKNAIDKIMPYPYANDKPFKGNTKPLETIYGLRTYGDKSYITQRVELNSIDKKATKIKSIIDETIKNDLLNKLKENPTEQEWKLMLQNYIHPKKQTKVKKVMISVSEGEITKDSNNRERMGEFVDFGTKGTQHQFKHSKRHKGQILYFNEKGVVEVMPVYSNIKTTDVKDKLQNMGCKLYNKGQMFYSGCLVDIPKPFKAGSKEYPAGRYQIKTIRSDKVAELEDACGNKISTNVKYLVPAEFKKVESK

SEQ ID NO: 71 - protein, 1059 aa, Artificial Sequence
  Description of Artificial Sequence: Synthetic polypeptide
  Category: nickase
  Description: nMG1-6 (D13A) nickase
MEKEKNNHVWGFAIGKGSLGEAVRVGGDFKHIASVLLDPEFGEIKTAALARRQMRTRKAHKAREKWLEECLDGTGVEILKRREVGIVDGQWRLISKGDERLEREFPPNGEEVCYNSIALRCKLLLGEKLEGWQVFKALNSAIQKRGYDENIPWGEAEEKSSKKDEDDYAQKLSQYEREKSELFESFADGEKYDFPCFFKAYKMGLWSPENPRRVEVRIDCRAQKAKSYVVARKYVEREFECLVEAAAKFFPKLKGRAKFILYGVSETPYASYYGNMRKKFGLKRGAESDWTALGQKVPRFDNRIIDKCRLIPRMNVCKIRPLNEARNEKDLLYYEVTLALKLLNLRFFRNSNIEQLTFEEFKKAFEIASGAKYKMTKTAMKKFLKSISATALGDDYAEIEPPKESGRASFSRPAMDILKELIFSGMPPREFYGRKIPEISNTDKNKGVVASDLDFIKLMGDCPWGGIFIPDVQTYQFANAAFPNPDAQINKLIGSQNNPIVRHRLTFFFERIKFLESKYGVPDKVVLEFVRDDFMGEKEKKEMRIAMKKRAEEKMMIAKDLDEHGFKGGNLLLKMELYRKQNGICLYTGDALPLSELATLEIEHIVPRSRGGPDAQYNYVITREKTNKLKGDKTPYEWLSSDAKEWASYTDRVNACAKALGKKRCRLLLEKDAEELVEKYTALAETAHIAKLAQKIVCMHFGFQFGGLSGTKRVFTVPGALTSRIRKFYGLDRILHNAAAESENLSFEEFLKFSEDLEKKNRKNKKHHALDAMCLCFAPTGVDSRRAKLGEILPEKLRSEKAAREFFKSYLDKIMPVDVAPKKPRLEDGIYSKRIIGGKACMVKRNNLVDLAYKSGLKPVFDIPTLIKLVDKKEKGIINPQIRKMIGEFAATNPDESAWRKWCEEVRLPSKSGLGARVLRVLVYYGEADEYKDLSKDGCGAYRKGDGHKGQVVWESVDGKYYVEPVYVHASKAGVMAALNANPKKKRICGMFNSHCTVDVGDVYNDRGDFILPAGRYMVNTILTTGRCVLTNADGEKRNPININYLMRAGMRRVELSEL

SEQ ID NO: 72 - protein, 1134 aa, Artificial Sequence
  Description of Artificial Sequence: Synthetic polypeptide
  Category: nickase
  Description: nMG3-6 (D13A) nickase
MSTDMKNYRIGVAVGDRSVGLAAIEFDDDGLPIQKLALVTFRHDGGLDPTKNKTPMSRKETRGIARRTMRMNRERKRRLRNLDNVLENLGYSVPEGPEPETYEAWTSRALLASIKLASADELNEHLVRAVRHMARHRGWANPWWSLDQLEKASQEPSETFEIILARARELFGEKVPANPTLGMLGALAANNEVLLRPRDEKKRKTGYVRGTPLMFAQVRQGDQLAELRRICEVQGIEDQYEALRLGVFDHKHPYVPKERVGKDPLNPSTNRTIRASLEFQEFRILDSVANLRVRIGSRAKRELTEAEYDAAVEFLMDYADKEQPSWADVAEKIGVPGNRLVAPVLEDVQQKTAPYDRSSAAFEKAMGKKTEARQWWESTDDDQLRSLLIAFLVDATNDTEEAAAEAGLSELYKSWPAEEREALSNIDFEKGRVAYSQETLSKLSEYMHEYRVGLHEARKAVFGVDDTWRPPLDKLEEPTGQPAVDRVLTILRRFVLDCERQWGRPRAITVEHTRTGLMGPTQRQKILNEQKKNRADNERIRDELRESGVDNPSRAEVRRHLIVQEQECQCLYCGTMITTTTSELDHIVPRAGGGSSRRENLAAVCRACNAKKKRELFYAWAGPVKSQETIERVRQLKAFKDSKKAKMFKNQIRRLNQTEADEPIDERSLASTSYAAVAVRERLEQHFNEGLALDDKSRVVLDVYAGAVTRESRRAGGIDERILLRGERDKNRFDVRHHAVDAAVMTLLNRSVALTLEQRSQLRRTFYEQGLDKLDRNQLKPEEDWRDFTGLAPASQEKFLEWRKAATILGDLLAEAIEDDSIAVVSPLRLRPQNGSVHLETISAVKKQTLGSDWPADAVKRIVDPEIYLAMKDALGKLKELPEDSARSLELPDGRFVEADDEVLFFPENAASILTPRGVAEIGGSIHHARLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEG

SEQ ID NO: 73 - protein, 1131 aa, Artificial Sequence
  Description of Artificial Sequence: Synthetic polypeptide
  Category: nickase
  Description: nMG3-7 (D12A) nickase
MSEHTKYRIGIAVGDRSVGLAAIEFDDDGFPLSNLAMVTYRHDGGLDPTTNKSPKSRKETRGVALRTMRMRRRKKSRLKDLDKTLRALGYVVPACEEPQTYEAWKSRALLATTKVEGAQELGEHLVRAVRHMARHRGWRNPWWTFNQLEIASTAPSDTFAKIRERAEKEWPGVVPEEATLGMIGALAASNNVLLRPRTYRKDQPRHSKKLNVLGQEPILVDKVRQEDLLAELRTICKKQDIEDQYEKLAQAVFEQTRPYVPLDRVGKDPLQPNKSRASRASLEFQRFRILDAVAHLRVRVGASDRRALTDEEHDKAVHFLMGYSKKDVPTWGDVADEIGVEPAHLIAPVIDDVRLNKAPYDRSSTEFEQKMKKKTRARQWWDEANLESRSQLILLVSDPTDETMRLAEVSGLYEVFESWPDEEKEALEGLKVESGRAAYSTDTLNKLSDHMRLKRIDLHEARKIAFGVDDMWHPPLDRIDEPTGQPTVDRVLTIVRRFIFDCERAWGCPENVVIEHARTGLMGPAQRADVLNEIAKNRKKNDKIREDLRAGGINNPTRADIRRNAIVQDQESQCLYCGATIGVSYSELDHIVPRAGGGSSRRENLAAVCRACNDSKKDTPFAVWAKNTSRPVTLEGTIQRLRELKAFKRPKDRRMVDLIIRRLKQTEKDDPIDERSLASTSYAATAIRERIEQYFNEKAEKLDLAKVHIDVYSGSLTRESRRAGGIDKMVLLRGQSDKNRFDVRHHAIDAAVLTLLNRSVAVTLEQRRLIKQQREYSLEKSRRERDNVWRDFMGLGPAAQEKFAKWKKTAYVLADIIKEAISNDAIPVVSPLRLRPQNGSVHLDTVDAVLERTIGDAWTVDQVHRIVNPQIYLAFAGYLGNQKALDPDSSRVLALNDGRKLTAEDVIYVFPEKAASILTPRGVVKIGESVHHVRLYAWKNRKGKAEVGMLRVFGAEFPWLMRESGVKDVLRVPIHTGSQSYRDLSFTVRKNIEKGEAAEIGWLTQNEELEFNPESYLQEGGKDKLAKFLAFLPETRWRVDGFPMPDKLRIRPALLSREEIPEGVFRTEEQSLLEEALTKGLIIATKGLLSLPDVKVLRRNNLGIPRWRGGSYRPVSLDIQRAALAALDEQE

SEQ ID NO: 74 - protein, 1132 aa, Artificial Sequence
  Description of Artificial Sequence: Synthetic polypeptide
  Category: nickase
  Description: nMG3-8 (D13A) nickase
MSTDMKNYRIGVAVGDRSVGLAAIEFDDAGFPIQKLALVTFRHDGGLDPTDNPKSRKETRGEARRRMRMTRRRKQRLRDLDKVLENLGYTVPEGPEPETYEAWTSRALLASIKLASADELNEHLVRAVRHIARHRGWVNPWWSLDQLERASQEPSETFEIILARARELFGERVPANPTLGMLGALAANNEVLLRPRAEKKKKTGYVRGTPLLAAQVRQIDQVAELRRICEVQGIEEQYETLRNAIFAHKVAYVPTERVGKDPLAPSKNRTIRASLEFQEFRILDSVANLRVRTDSRAKRELTEGEYDAAVEFLMGYTAKEQPSWADVAEEIGVPGNRLIAPVLEDVQQKTAPFDRSSAAFEKAMSKRTEARQWWEANDDDQLRSLFIMFLADATNDTEEAAAVAGLPELYMSWPAEEREALSNIDFEKGRVAYSHETLSKLSEYMHEHRVGLHEARKAVFGVDDTWRPPLAKLEEPTGQPTVDRVLTILRRFVLDCERQWGRPRAITVEHARIGLVGPAQRQNILKEQEDNRKNNECIRDELRKSGVENPSRTEVRRHLVVQDQESQCLYCGAVIRTDTSELDHIVPRAGGGSSRRENLAAVCRYCNSKKDRTLFYDWAGSVRLQETIDRVRQLKAFKDSKKAKMFKNQIRRLRQTEADEPIDERSLASTSYAAVAVRERLEQHFNEGLAPDDKNRVVLDVYAGSVTRESRRAGGIDERILLRGERDKNRFDVRHHAIDAAVMTLLNRSVALTLEQRSQLRRAFYEQGLDKLDRDQLKPEEDWRNFIGLSLASQEKFLEWKKVTTVLGDLLAEAIEDDSIAVVSPLRLRPQNGRVHKDTIAAVKKQTLGSAWSADAVKRIVDPEIYLAMKDALGKSKVLPEDSARTLELSDGRYLEADDEVLFFPKNAASILTPRGVAEIGGSIHHARLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEG

SEQ ID NO: 75 - protein, 1055 aa, Artificial Sequence
  Description of Artificial Sequence: Synthetic polypeptide
  Category: nickase
  Description: nMG4-5 (D17A) nickase
MGDQQTLQATSYCLGLAVGVQGVGWAVIDLDDQGQPLGVRRTGVRCFDSGVGSETEFEKGVDEPPSTKRRQARQQRRQLWRRAQRQRRVFRALQEAGLLPPGPPTPVSRDKILRTLDADLAIQFGSLEDRIAAHLLPYRLRALALDTPLPPYALGRAFYHLAQRRGFLSNKKALKEEKEAGEVKKGIAELQEEMNRAGARALGEYFSSLDPEQRRIRNRWTARQMYLDEFDRVWEAQSRYHPRLTDELKTKVRRAIFFQRPLKSQKGLIGRCELEPRHRRAPLASLLAQRFRYWQKINDLEVIQPDGVVRPLSPEERHKLAHFLETQAEATFARIRKLLDLKKPKGSQEDFAFNLERGGEKRILGNRTAAKMAAVLGQRWAAMDDEDKRRLVNEILSFEKEAPLARRLVRAWNLDEPTAAQLAALDFEPGYAALSARAIRKLLPLMQREGMRFATARKQVYGDHLLGTRAYDALPPVAKAIPSLRNPAVCRALTEVRKVVNALVRAYGKPAMVRIELARDMKRGRKQRKETWQAMRENERCRLDARKLLQDHGIQEPRPADILKVLLAEECNWECPYTGKAISMDALIGSQPQFDVEHIIPFSRSLDNSFLNKTLCYHEENRNVKQNRTPFEAYGGDEQRWHEILQRVRRFRGSAAESKLRKFQLRQLPADFTNRHLNDTRYASRLAADYLALLYGGRVDANGRQRVQVGTGATTGFLRDEWGLNAILGDNDEKERADHRHHAIDAVVIALTGPGTVQALTRAALRAKELGRRLFVPLDPPWADRDSFLRDVRASVEAITVSYRVDRKVSGQLHEESNYSKPHMTVDNKGNLVEHRHIRKPLKDMSVEEVEAIVDDRVRKLVQEKLRQLGQEPKKAFADEANHPYFTTADGRLVPIHKARIRKTVATITVGPPQCPRHVAPGLNHHIEILAVRDPAGAVTHWEGELVSLFEAARRVKAGEPVVRRNHGPNKDFLFSLAKGEYVEMELQPGKRQLFRVTVISAKQIEFRLHHDARPTMLLRKTPGARVIRSPGSLFKAKARKVAVDPLGNVFPAND

SEQ ID NO: 76 - protein, 1003 aa, Artificial Sequence
  Description of Artificial Sequence: Synthetic polypeptide
  Category: nickase
  Description: nMG14-1 (D23A) nickase
MEITINREIGKLGLPRHLVLGMAPGIASCGFALIDTANHEILDLGVRLFDSPTHPKTGQSLAVIRRGFRSTRRNIDRTQARLKHCLQVLKAYGLIPQDATKEYFHTTKGDKQPLKLRVDGLDRLLNDREWALVLYSLCKRRGYIPHGEGNQDKSSEGGKVLSALAANKEAIAETSCRTVGEWLAQQPQSRNRGGNYDKYVTHAQLIEETHILFDAQRSFGSKYASPEFEAAYIEVCDWERSRKDFDRRTYDLVGHCSYFPTEKRAARCTLTSELVSAYGALGNITIIHENGTSRALSATERDECIAILFSCEPIRGNKDCAVKFGALRKALDLSSGDYFKGVPAADEKTREVYKPKGWRVLRNTLNAANPILLQRLRDDRDLADAVMEAVAYSSALPVLQEQLQGLPLSEAEIEALCRLPYSSKALNGYGNRSKKALDMLLDCLEEPEVLNLTQAENDCGLLGLRIAGAQLERSDRLMPYETWIERTGRTNNNPVVIRSMSQMRKVVNAICRKWGVPNEIHVELDRELRLPQRAKDEIAKANKKNEKNRERIAGQIAELRGCTADEVTGKQIEKYRLWEEQEYFDLYTGAKIEVDRLISDDTYTQIDHILPFSRTGENSRNNKVLVLAKSNQDKREQTPYEWMSHDGAPSWDAFERRVQENQKLSRRKKNFLLEKDLDTKEGEFLARSFTDTAYMSREVCAYLADCLLFPDDGAKAHVVPTTGRATAWLRRRWGLNFGSNGEKDRSDDRHHATDACVIAACSPSLVIKTARINQETHWSITRGMNETQRRDAIMKALESVMPWETFANEVRAAHDFVVPTRFVPRKGKGELFEQTVYRYAGVNAQGKDIARKASSDKDIVMGNAVVSADEKSVIKVSEMLCLRLWHDPEAKKGQGAWYADPVYKADIPALKDGTYVPRIAKAHTGRKAWKPVPESAMAKPPLEIYFGDLVQIGDFIGRFSGYNINNANWSFTDRLTRLNLSCPTVGQLNNDLSPVVIRESPIK

SEQ ID NO: 77 - protein, 1082 aa, Artificial Sequence
  Description of Artificial Sequence: Synthetic polypeptide
  Category: nickase
  Description: nMG15-1 (D8A) nickase
MNYVLGLAVGIASVGWAVLELNEEDNPIRIEGLGARIFDKAEVPKTGASLAAPRRMSRGIRRVIRRRRFRLQRVRSYLKKHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIEKYLEEGGIGKADGEALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEENFIFSLYPNDLIFVDAGKEIPFKAALKGSTLDPEKKASRFLMYYKGADIATGSISGVNHDETYKARGVGIQSLREIKKCCIDVLGNISFASKEKRQTFR

SEQ ID NO: 78 - protein, 1348 aa, Artificial Sequence
  Description of Artificial Sequence: Synthetic polypeptide
  Category: nickase
  Description: nMG18-1 (D12A) nickase
MDQSKEYYIGLAGGTDSVGWAVLNPDYTVVKKRGKSLWGVRLFESGQTAAERRLARSARRRTDRKKWRLKLLKELFAEEVAACDPAFFARLAESRYWEDDKKVDGADTLFHDADFTDKDYHRQFPTIYHLRRHLMCCTEKPDIRLLYLAVAHMIKNRGHFLNEGQDLNQVRRFDDVWQNLCAAVSDVLGIELAVENGAKAAEVLTSSVKIKEKTKQLESVLGEGESEADRSVCKALAGLLAGAKVSAVDLFNGDEALKECGKFSLAEKSIEELEPDLGDALGEERFSLLQYAYAAYNWAVFARLLPEGKTISEVKTEEYEAYKADLRALKQLVKQYASDQYYRVFRSAKIKGNYASYVGKTNCGNEKSNPESCKPEEFFAFLKKELKPLWSQNIPAAASLAAKLESGTLLRRQRSGENAAIPYQAHLQELQIILKNMQQFYPFLQKADENGFTPAYKIEKLLTFRIPYYVGPLNDAHKEKGFCWIVKKADVPVLPWNFDQVVDENACEDAFIGRMSATCTYLVGENVLPQNSPLYCRFMVLNELNNLRIRSEKITPALKQAIFTQLFCAGKGGKVTQKKLLDFLHSQGIDANKQDISGIDGDFKASMAPAVKLQSIFTEPLPPEILERLAFALTVSGESHKMLQNRIRAILPNADNAVIRKVCALKFTGWGRLSQKLLTEIYDVDQTTGECRSLMDLLWSTNNNLMQLLSGDFTFAAGIDAYNAAQNGTENIFDYDHLVKDLYVSPSVKRGLWQTLLLVKEVRKIMGCDPARVFIEMARGVSPEQKNKRTVSRKDQLLALYKACKEDARDWCGELEALPEDKLRSDKLYLYYTQMGRCMYSGEPIRLDDLMHDTANQLYDIDHIYPQSKTKDDSLTNRVLVKRQLNAIKSNDYPLPQTMRQTALWKALLEKGLISKQKYLRLTRTTPFTEEELAGFINRQLVETRQSTKAAAHLLEQLLPNTEVVYVKAGLAADFRQEFGFVKCRDANDFHHAKDAYLNAVVGNVYHEKFTKNPLRFVRSGQEYSLNLSALFQNWNIYKGGRVIWQKGEDGSLETVRARMAKNDPMVTRYCTEGRGALYDLQPMKKSKGQLPLKSSDERLQHIDRYGGYNKLAGAYFTLAAYYKKGKRVKSIESVPLYLAAKLQRDPAALQQYLADQLGTDRVEILVPEIKLGTLFKWNGYPMTLSGRTGPQLLFRNAAELRTNAEQEQYIKKMSRYLEKCKGRKEPLPIRPAYDKLTPEENLQLYDAFTQWLTSGIYAKRLSLQGKFLLEKRDAFAALSPEAQVRQLMEILHLFQCNPVAANLSELGGAAHAGILLASKNIDGKVPVSIVHQSVTGYFTQEVCLNDL

SEQ ID NO: 79 - DNA, 37 bp, Artificial Sequence
  Description of Artificial Sequence: Synthetic oligonucleotide
  Category: target sequence
  Description: nMG1-4 (D9A) protospacer and PAM for in vitro nickase assay
ccgtgagccaccacgtcgcaagcctcgaccaggaagg

SEQ ID NO: 80 - DNA, 38 bp, Artificial Sequence
  Description of Artificial Sequence: Synthetic oligonucleotide
  Category: target sequence
  Description: nMG1-6 (D13A) protospacer and PAM for in vitro nickase assay
tccgtgagccaccacgtcgcaagcctcgactagaacgg

SEQ ID NO: 81 - DNA, 32 bp, Artificial Sequence
  Description of Artificial Sequence: Synthetic oligonucleotide
  Category: target sequence
  Description: nMG3-6 (D13A) protospacer and PAM for in vitro nickase assay
agccaccacgtcgcaagcctcgacgtgggtta

SEQ ID NO: 82 - DNA, 31 bp, Artificial Sequence
  Description of Artificial Sequence: Synthetic oligonucleotide
  Category: target sequence
  Description: nMG3-7 (D12A) protospacer and PAM for in vitro nickase assay
agccaccacgtcgcaagcctcgacgtgttac

SEQ ID NO: 83 - DNA, 32 bp, Artificial Sequence; identical to SEQ ID NO: 81
  Description of Artificial Sequence: Synthetic oligonucleotide
  Category: target sequence
  Description: nMG3-8 (D13A) protospacer and PAM for in vitro nickase assay

SEQ ID NO: 84 - DNA, 29 bp, Artificial Sequence
  Description of Artificial Sequence: Synthetic oligonucleotide
  Category: target sequence
  Description: nMG4-5 (D17A) protospacer and PAM for in vitro nickase assay
agccaccacgtcgcaagcctcgacggcca

SEQ ID NO: 85 - DNA, 40 bp, Artificial Sequence
  Description of Artificial Sequence: Synthetic oligonucleotide
  Category: target sequence
  Description: nMG14-1 (D23A) protospacer and PAM for in vitro nickase assay
tccgtgagccaccacgtcgcaagcctcgacggcggggacg

SEQ ID NO: 86 - DNA, 37 bp, Artificial Sequence
  Description of Artificial Sequence: Synthetic oligonucleotide
  Category: target sequence
  Description: nMG15-1 (D8A) protospacer and PAM for in vitro nickase assay
ccgtgagccaccacgtcgcaagcctcgactggacctg

SEQ ID NO: 87 - DNA, 32 bp, Artificial Sequence
  Description of Artificial Sequence: Synthetic oligonucleotide
  Category: target sequence
  Description: nMG18-1 (D12A) protospacer and PAM for in vitro nickase assay
agccaccacgtcgcaagcctcgaccgtaattg

SEQ ID NO: 88 - DNA, 121 bp, Artificial Sequence
  Description of Artificial Sequence: Synthetic polynucleotide
  Category: single guide RNA
  Description: nMG1-4 (D9A) single guide RNA for in vitro nickase assay
ccaccacgtcgcaagcctcgacgttttgatttactcgaaagagtccaatcataattgaccggagaataattgattcctctacaatgtacgaataaattcattctctaaaccttaaaaattt

SEQ ID NO: 89 - DNA, 99 bp, Artificial Sequence
  Description of Artificial Sequence: Synthetic oligonucleotide
  Category: single guide RNA
  Description: nMG1-6 (D13A) single guide RNA for in vitro nickase assay
ccaccacgtcgcaagcctcgacgttttgacttgaaaaagtcttaactgattttgccgaatttcaagctctgcattgcaccttggcattcggcatatttt

SEQ ID NO: 90 - DNA, 110 bp, Artificial Sequence
  Description of Artificial Sequence: Synthetic polynucleotide
  Category: single guide RNA
  Description: nMG3-6 (D13A) single guide RNA for in vitro nickase assay
ccaccacgtcgcaagcctcgacgttgagaatcgaaagattcttaataaggcatccttccgatgctgacttctcaccgtccgttttccaataggagcgggcggtatgtttt

SEQ ID NO: 91 - DNA, 113 bp, Artificial Sequence
  Description of Artificial Sequence: Synthetic polynucleotide
  Category: single guide RNA
  Description: nMG3-7 (D12A) single guide RNA for in vitro nickase assay
ccaccacgtcgcaagcctcgacgttgggaaccgaaaggttcccaataaggcgcatcttggcgctgacttctcaccgtcctcttgctgcttagcagagggcggtatgttttttt

SEQ ID NO: 92 - DNA, 118 bp, Artificial Sequence
  Description of Artificial Sequence: Synthetic polynucleotide
  Category: single guide RNA
  Description: nMG3-8 (D13A) single guide RNA for in vitro nickase assay
ccaccacgtcgcaagcctcgacgttgagaatctttcgaaagaaagattcttaataaggcatccttccgatgctgacttctcaccgtccggctcctcttaggaacgggcggtatgtttt

SEQ ID NO: 93 - DNA, 124 bp, Artificial Sequence
  Description of Artificial Sequence: Synthetic polynucleotide
  Category: single guide RNA
  Description: nMG4-5 (D17A) single guide RNA for in vitro nickase assay
ccaccacgtcgcaagcctcgacgctgtggcttgcgggggaaaccccttgtcacagtaagggactttcgttcgcgaaaggcaacctcgccagcatcgctgggcgaggaccagggcaaggcgattt

SEQ ID NO: 94 - DNA, 118 bp, Artificial Sequence
  Description of Artificial Sequence: Synthetic polynucleotide
  Category: single guide RNA
  Description: nMG14-1 (D23A) single guide RNA for in vitro nickase assay
ccaccacgtcgcaagcctcgacgtcttgagcgaaagctccagacaaggggagccacttaagtggcttacccgtaaagtaacccccgttcaatcttcggattgggcggggcgaactttt

SEQ ID NO: 95 - DNA, 118 bp, Artificial Sequence
  Description of Artificial Sequence: Synthetic polynucleotide
  Category: single guide RNA
  Description: nMG15-1 (D8A) single guide RNA for in vitro nickase assay
ccaccacgtcgcaagcctcgacgttgtaattccctagaaataggttattacaataaggtccaacaggagtgttggtaccgtaaagctctaacggcacccacgggtgccgttatctttt

SEQ ID NO: 96 - DNA, 101 bp, Artificial Sequence
  Description of Artificial Sequence: Synthetic polynucleotide
  Category: single guide RNA
  Description: nMG18-1 (D12A) single guide RNA for in vitro nickase assay
ccaccacgtcgcaagcctcgacgtttgagagtagtgaaaactacgagttcaaatacaattttttcaaattgccctatagggccctcacagtgtgagatttt

SEQ ID NO: 97 - DNA, 22 bp, Artificial Sequence
  Description of Artificial Sequence: Synthetic oligonucleotide
  Category: spacer
  Description: MGA1-4 sgRNA spacer 1 (targeting E. coli lacZ)
cgtttgccgtctgaatttgacc

SEQ ID NO: 98 - DNA, 22 bp, Artificial Sequence
  Description of Artificial Sequence: Synthetic oligonucleotide
  Category: spacer
  Description: MGA1-4 sgRNA spacer 2 (targeting E. coli lacZ)
gaagatcaggatatgtggcgga

SEQ ID NO: 99 - DNA, 22 bp, Artificial Sequence
  Description of Artificial Sequence: Synthetic oligonucleotide
  Category: spacer
  Description: MGA1-4 sgRNA spacer 3 (targeting E. coli lacZ)
acgggtaacagtttctttatgg

SEQ ID NO: 100 - DNA, 22 bp, Artificial Sequence
  Description of Artificial Sequence: Synthetic oligonucleotide
  Category: spacer
  Description: MGA1-6 sgRNA spacer 1 (targeting E. coli lacZ)
cgttgctgcataaaccgactac

SEQ ID NO: 101 - DNA, 22 bp, Artificial Sequence
  Description of Artificial Sequence: Synthetic oligonucleotide
  Category: spacer
  Description: MGA1-6 sgRNA spacer 2 (targeting E. coli lacZ)
aaaacccgaaactgtggagcgc

SEQ ID NO: 102 - DNA, 22 bp, Artificial Sequence
  Description of Artificial Sequence: Synthetic oligonucleotide
  Category: spacer
  Description: MGA1-6 sgRNA spacer 3 (targeting E. coli lacZ)
gattgaaaatggtctgctgctg

SEQ ID NO: 103 - DNA, 22 bp, Artificial Sequence
  Description of Artificial Sequence: Synthetic oligonucleotide
  Category: spacer
  Description: MGA3-6 sgRNA spacer 1 (targeting E. coli lacZ)
tacgggtaacagtttctttatg

SEQ ID NO: 104 - DNA, 22 bp, Artificial Sequence
  Description of Artificial Sequence: Synthetic oligonucleotide
  Category: spacer
  Description: MGA3-6 sgRNA spacer 2 (targeting E. coli lacZ)
gcgttggcaatttaaccgccag

SEQ ID NO: 105 - DNA, 22 bp, Artificial Sequence
  Description of Artificial Sequence: Synthetic oligonucleotide
  Category: spacer
  Description: MGA3-6 sgRNA spacer 3 (targeting E. coli lacZ)
ctgaatatcgacggtttccata

SEQ ID NO: 106 - DNA, 22 bp, Artificial Sequence
  Description of Artificial Sequence: Synthetic oligonucleotide
  Category: spacer
  Description: MGA3-7 sgRNA spacer 1 (targeting E. coli lacZ)
cacatttaatgttgatgaaagc

SEQ ID NO: 107 - DNA, 22 bp, Artificial Sequence
  Description of Artificial Sequence: Synthetic oligonucleotide
  Category: spacer
  Description: MGA3-7 sgRNA spacer 2 (targeting E. coli lacZ)
acacaaatcagcgatttccatg

SEQ ID NO: 108 - DNA, 22 bp, Artificial Sequence
  Description of Artificial Sequence: Synthetic oligonucleotide
  Category: spacer
  Description: MGA3-7 sgRNA spacer 3 (targeting E. coli lacZ)
atggatgagcagacgatggtgc

SEQ ID NO: 109 - DNA, 22 bp, Artificial Sequence
  Description of Artificial Sequence: Synthetic oligonucleotide
  Category: spacer
  Description: MGA3-8 sgRNA spacer 1 (targeting E. coli lacZ)
ttcatctgtggtgcaacgggcg

SEQ ID NO: 110 - DNA, 22 bp, Artificial Sequence
  Description of Artificial Sequence: Synthetic oligonucleotide
  Category: spacer
  Description: MGA3-8 sgRNA spacer 2 (targeting E. coli lacZ)
acgagcatcatcctctgcatgg

SEQ ID NO: 111 - DNA, 22 bp, Artificial Sequence
  Description of Artificial Sequence: Synthetic oligonucleotide
  Category: spacer
  Description: MGA3-8 sgRNA spacer 3 (targeting E. coli lacZ)
cgacccgcattgaccctaacgc

SEQ ID NO: 112 - DNA, 22 bp, Artificial Sequence
  Description of Artificial Sequence: Synthetic oligonucleotide
  Category: spacer
  Description: MGA4-5 sgRNA spacer 1 (targeting E. coli lacZ)
cacaaatcagcgatttccatgt

SEQ ID NO: 113 - DNA, 22 bp, Artificial Sequence
  Description of Artificial Sequence: Synthetic oligonucleotide
  Category: spacer
  Description: MGA4-5 sgRNA spacer 2 (targeting E. coli lacZ)
tgatgaagcagaacaactttaa

SEQ ID NO: 114 - DNA, 22 bp, Artificial Sequence
  Description of Artificial Sequence: Synthetic oligonucleotide
  Category: spacer
  Description: MGA4-5 sgRNA spacer 3 (targeting E. coli lacZ)
aatattgaaacccacggcatgg

SEQ ID NO: 115 - DNA, 22 bp, Artificial Sequence
  Description of Artificial Sequence: Synthetic oligonucleotide
  Category: spacer
  Description: MGA14-1 sgRNA spacer 1 (targeting E. coli lacZ)
tcaaaaaatggctttcgctacc

SEQ ID NO: 116 - DNA, 22 bp, Artificial Sequence
  Description of Artificial Sequence: Synthetic oligonucleotide
  Category: spacer
  Description: MGA14-1 sgRNA spacer 2 (targeting E. coli lacZ)
aagcagcgttgttgcagtgcac

SEQ ID NO: 117 - DNA, 22 bp, Artificial Sequence
  Description of Artificial Sequence: Synthetic oligonucleotide
  Category: spacer
  Description: MGA14-1 sgRNA spacer 3 (targeting E. coli lacZ)
tcagccggaaaacctaccggat

SEQ ID NO: 118 - DNA, 22 bp, Artificial Sequence
  Description of Artificial Sequence: Synthetic oligonucleotide
  Category: spacer
  Description: MGA15-1 sgRNA spacer 1 (targeting E. coli lacZ)
gaagatcaggatatgtggcgga

SEQ ID NO: 119 - DNA, 22 bp, Artificial Sequence
  Description of Artificial Sequence: Synthetic oligonucleotide
  Category: spacer
  Description: MGA15-1 sgRNA spacer 2 (targeting E. coli lacZ)
aacgtcgaaaacccgaaactgt

SEQ ID NO: 120 - DNA, 22 bp, Artificial Sequence
  Description of Artificial Sequence: Synthetic oligonucleotide
  Category: spacer
  Description: MGA15-1 sgRNA spacer 3 (targeting E. coli lacZ)
aaacccacggcatggtgccaat

SEQ ID NO: 121 - DNA, 22 bp, Artificial Sequence
  Description of Artificial Sequence: Synthetic oligonucleotide
  Category: spacer
  Description: MGA18-1 sgRNA spacer 1 (targeting E. coli lacZ)
aaaacccgaaactgtggagcgc

SEQ ID NO: 122 - DNA, 22 bp, Artificial Sequence
  Description of Artificial Sequence: Synthetic oligonucleotide
  Category: spacer
  Description: MGA18-1 sgRNA spacer 2 (targeting E. coli lacZ)
ggcaactctggctcacagtacg

SEQ ID NO: 123 - DNA, 22 bp, Artificial Sequence
  Description of Artificial Sequence: Synthetic oligonucleotide
  Category: spacer
  Description: MGA18-1 sgRNA spacer 3 (targeting E. coli lacZ)
ccggaaaacctaccggattgat

SEQ ID NO: 124 - DNA, 20 bp, Artificial Sequence
  Description of Artificial Sequence: Synthetic oligonucleotide
  Category: spacer
  Description: ABE8.17m sgRNA spacer 1 (targeting E. coli lacZ)
tttctttcacagatgtggat

SEQ ID NO: 125 - DNA, 20 bp, Artificial Sequence
  Description of Artificial Sequence: Synthetic oligonucleotide
  Category: spacer
  Description: ABE8.17m sgRNA spacer 2 (targeting E. coli lacZ)
caggatatgtggcggatgag

SEQ ID NO: 126 - DNA, 20 bp, Artificial Sequence
  Description of Artificial Sequence: Synthetic oligonucleotide
  Category: spacer
  Description: ABE8.17m sgRNA spacer 3 (targeting E. coli lacZ)
tgcgaatacgcccacgcgat

SEQ ID NO: 127 - DNA, 22 bp, Artificial Sequence
  Description of Artificial Sequence: Synthetic oligonucleotide
  Category: spacer
  Description: MGC1-4 sgRNA spacer 1 (targeting E. coli lacZ)
cggcgtttcatctgtggtgcaa

SEQ ID NO: 128 - DNA, 22 bp, Artificial Sequence
  Description of Artificial Sequence: Synthetic oligonucleotide
  Category: spacer
  Description: MGC1-4 sgRNA spacer 2 (targeting E. coli lacZ)
gccaggacagtcgtttgccgtc

SEQ ID NO: 129 - DNA, 22 bp, Artificial Sequence
  Description of Artificial Sequence: Synthetic oligonucleotide
  Category: spacer
  Description: MGC1-4 sgRNA spacer 3 (targeting E. coli lacZ)
tcagccgcgctgtactggaggc

SEQ ID NO: 130 - DNA, 22 bp, Artificial Sequence
  Description of Artificial Sequence: Synthetic oligonucleotide
  Category: spacer
  Description: MGC1-6 sgRNA spacer 1 (targeting E. coli lacZ)
cccttcccaacagttgcgcagc

SEQ ID NO: 131 - DNA, 22 bp, Artificial Sequence
  Description of Artificial Sequence: Synthetic oligonucleotide
  Category: spacer
  Description: MGC1-6 sgRNA spacer 2 (targeting E. coli lacZ)
ctgtcgtcgtcccctcaaactg

SEQ ID NO: 132 - DNA, 22 bp, Artificial Sequence
  Description of Artificial Sequence: Synthetic oligonucleotide
  Category: spacer
  Description: MGC1-6 sgRNA spacer 3 (targeting E. coli lacZ)
ctacgtctgaacgtcgaaaacc

SEQ ID NO: 133 - DNA, 22 bp, Artificial Sequence
  Description of Artificial Sequence: Synthetic oligonucleotide
  Category: spacer
  Description: MGC3-6 sgRNA spacer 1 (targeting E. coli lacZ)
gtgacggcagttatctggaaga

SEQ ID NO: 134 - DNA, 22 bp, Artificial Sequence
  Description of Artificial Sequence: Synthetic oligonucleotide
  Category: spacer
  Description: MGC3-6 sgRNA spacer 2 (targeting E. coli lacZ)
atgatttcagccgcgctgtact

SEQ ID NO: 135 - DNA, 22 bp, Artificial Sequence
  Description of Artificial Sequence: Synthetic oligonucleotide
  Category: spacer
  Description: MGC3-6 sgRNA spacer 3 (targeting E. coli lacZ)
ttactgccgcctgttttgaccg

SEQ ID NO: 136 - DNA, 22 bp, Artificial Sequence
  Description of Artificial Sequence: Synthetic oligonucleotide
  Category: spacer
  Description: MGC3-7 sgRNA spacer 1 (targeting E. coli lacZ)
cgaatggcgctttgcctggttt

SEQ ID NO: 137 - DNA, 22 bp, Artificial Sequence
  Description of Artificial Sequence: Synthetic oligonucleotide
  Category: spacer
  Description: MGC3-7 sgRNA spacer 2 (targeting E. coli lacZ)
tcccctcaaactggcagatgca

SEQ ID NO: 138 - DNA, 22 bp, Artificial Sequence
  Description of Artificial Sequence: Synthetic oligonucleotide
  Category: spacer
  Description: MGC3-7 sgRNA spacer 3 (targeting E. coli lacZ)
atctacaccaacgtgacctatc

SEQ ID NO: 139 - DNA, 22 bp, Artificial Sequence
  Description of Artificial Sequence: Synthetic oligonucleotide
  Category: spacer
  Description: MGC3-8 sgRNA spacer 1 (targeting E. coli lacZ)
ttcatctgtggtgcaacgggcg

SEQ ID NO: 140 - DNA, 22 bp, Artificial Sequence
  Description of Artificial Sequence: Synthetic oligonucleotide
  Category: spacer
  Description: MGC3-8 sgRNA spacer 2 (targeting E. coli lacZ)
acgagcatcatcctctgcatgg

SEQ ID NO: 141 - DNA, 22 bp, Artificial Sequence
  Description of Artificial Sequence: Synthetic oligonucleotide
  Category: spacer
  Description: MGC3-8 sgRNA spacer 3 (targeting E. coli lacZ)
cgacccgcattgaccctaacgc

SEQ ID NO: 142 - DNA, 22 bp, Artificial Sequence
  Description of Artificial Sequence: Synthetic oligonucleotide
  Category: spacer
  Description: MGC4-5 sgRNA spacer 1 (targeting E. coli lacZ)
caacgggcgctgggtcggttac

SEQ ID NO: 143 - DNA, 22 bp, Artificial Sequence
  Description of Artificial Sequence: Synthetic oligonucleotide
  Category: spacer
  Description: MGC4-5 sgRNA spacer 2 (targeting E. coli lacZ)
cacaaatcagcgatttccatgt

SEQ ID NO: 144 - DNA, 22 bp, Artificial Sequence
  Description of Artificial Sequence: Synthetic oligonucleotide
  Category: spacer
  Description: MGC4-5 sgRNA spacer 3 (targeting E. coli lacZ)
aaggcggcggagccgacaccac

SEQ ID NO: 145 - DNA, 22 bp, Artificial Sequence
  Description of Artificial Sequence: Synthetic oligonucleotide
  Category: spacer
  Description: MGC14-1 sgRNA spacer 1 (targeting E. coli lacZ)
cggtcaatccgccgtttgttcc

SEQ ID NO: 146 - DNA, 22 bp, Artificial Sequence
  Description of Artificial Sequence: Synthetic oligonucleotide
  Category: spacer
  Description: MGC14-1 sgRNA spacer 2 (targeting E. coli lacZ)
tcctttgcgaatacgcccacgc

SEQ ID NO: 147 - DNA, 22 bp, Artificial Sequence
  Description of Artificial Sequence: Synthetic oligonucleotide
  Category: spacer
  Description: MGC14-1 sgRNA spacer 3 (targeting E. coli lacZ)
ggtcggcttacggcggtgattt

SEQ ID NO: 148 - DNA, 22 bp, Artificial Sequence
  Description of Artificial Sequence: Synthetic oligonucleotide
  Category: spacer
  Description: MGC15-1 sgRNA spacer 1 (targeting E. coli lacZ)
gccgatcgcgtcacactacgtc

SEQ ID NO: 149 - DNA, 22 bp, Artificial Sequence
  Description of Artificial Sequence: Synthetic oligonucleotide
  Category: spacer
  Description: MGC15-1 sgRNA spacer 2 (targeting E. coli lacZ)
gatccgcgctggctaccggcga

SEQ ID NO: 150 - DNA, 22 bp, Artificial Sequence
  Description of Artificial Sequence: Synthetic oligonucleotide
  Category: spacer
  Description: MGC15-1 sgRNA spacer 3 (targeting E. coli lacZ)
ccttcccgcccggtgcagtatg

SEQ ID NO: 151 - DNA, 22 bp, Artificial Sequence
  Description of Artificial Sequence: Synthetic oligonucleotide
  Category: spacer
  Description: MGC18-1 sgRNA spacer 1 (targeting E. coli lacZ)
tcagccgcgctgtactggaggc

SEQ ID NO: 152 - DNA, 22 bp, Artificial Sequence
  Description of Artificial Sequence: Synthetic oligonucleotide
  Category: spacer
  Description: MGC18-1 sgRNA spacer 2 (targeting E. coli lacZ)
gaccagcccttcccggctgtgc

SEQ ID NO: 153 - DNA, 22 bp, Artificial Sequence
  Description of Artificial Sequence: Synthetic oligonucleotide
  Category: spacer
  Description: MGC18-1 sgRNA spacer 3 (targeting E. coli lacZ)
tccgtttatccgggcaaaccat

SEQ ID NO: 154 - DNA, 20 bp, Artificial Sequence
  Description of Artificial Sequence: Synthetic oligonucleotide
  Category: spacer
  Description: BE3 sgRNA spacer 1 (targeting E. coli lacZ)
cctctggatgtcgctccaca

SEQ ID NO: 155 - DNA, 20 bp, Artificial Sequence
  Description of Artificial Sequence: Synthetic oligonucleotide
  Category: spacer
  Description: BE3 sgRNA spacer 2 (targeting E. coli lacZ)
gggacgcgcgaattgaatta

SEQ ID NO: 156 - DNA, 20 bp, Artificial Sequence
  Description of Artificial Sequence: Synthetic oligonucleotide
  Category: spacer
  Description: BE3 sgRNA spacer 3 (targeting E. coli lacZ)
cgttttacaacgtcgtgact

SEQ ID NO: 157 - DNA, 40 bp, Artificial Sequence
  Description of Artificial Sequence: Synthetic primer
  Category: primer
  Description: Site-directed mutagenesis of MG1-4 (D9A)
tgaaaaagaaagttttcgcatttgcgcttggtaaagcaag

SEQ ID NO: 158 - DNA, 27 bp, Artificial Sequence
  Description of Artificial Sequence: Synthetic primer
  Category: primer
  Description: Site-directed mutagenesis of MG1-4 (D9A)
tggtatatctccttcttaaagttaaac

SEQ ID NO: 159 - DNA, 35 bp, Artificial Sequence
  Description of Artificial Sequence: Synthetic primer
  Category: primer
  Description: Site-directed mutagenesis of MG1-6 (D13A)
accatgtttggggctttgcgattggcaaagggtct

SEQ ID NO: 160 - DNA, 25 bp, Artificial Sequence
  Description of Artificial Sequence: Synthetic primer
  Category: primer
  Description: Site-directed mutagenesis of MG1-6 (D13A)
tgttcttttctttctccatggtata

SEQ ID NO: 161 - DNA, 35 bp, Artificial Sequence
  Description of Artificial Sequence: Synthetic primer
  Category: primer
  Description: Site-directed mutagenesis of MG3-6 (D13A)
attatcgcattggcgtggcggtcggggatcgcagc

SEQ ID NO: 162 - DNA, 21 bp, Artificial Sequence
  Description of Artificial Sequence: Synthetic primer
  Category: primer
  Description: Site-directed mutagenesis of MG3-6 (D13A)
tcttcatatcggttgacatgg

SEQ ID NO: 163 - DNA, 35 bp, Artificial Sequence
  Description of Artificial Sequence: Synthetic primer
  Category: primer
  Description: Site-directed mutagenesis of MG3-7 (D12A)
agtaccgcattggcatcgcggtgggcgatcgctcg

SEQ ID NO: 164 - DNA, 22 bp, Artificial Sequence
  Description of Artificial Sequence: Synthetic primer
  Category: primer
  Description: Site-directed mutagenesis of MG3-7 (D12A)
tagtatgttcgctcatggtata

SEQ ID NO: 165 - DNA, 35 bp, Artificial Sequence
  Description of Artificial Sequence: Synthetic primer
  Category: primer
  Description: Site-directed mutagenesis of MG3-8 (D13A)
attaccgcattggcgtggcggtaggtgatcgtagt

SEQ ID NO: 166 - DNA, 21 bp, Artificial Sequence
  Description of Artificial Sequence: Synthetic primer
  Category: primer
  Description: Site-directed mutagenesis of MG3-8 (D13A)
tcttcatatcagtgctcatgg

SEQ ID NO: 167 - DNA, 35 bp, Artificial Sequence
  Description of Artificial Sequence: Synthetic primer
  Category: primer
  Description: Site-directed mutagenesis of MG4-5 (D17A)
gctactgcttgggcctggcggtaggtgtgcaagga

SEQ ID NO: 168 - DNA, 18 bp, Artificial Sequence
  Description of Artificial Sequence: Synthetic primer
  Category: primer
  Description: Site-directed mutagenesis of MG4-5 (D17A)
tggtcgcctgcagggtct

SEQ ID NO: 169 - DNA, 35 bp, Artificial Sequence
  Description of Artificial Sequence: Synthetic primer
  Category: primer
  Description: Site-directed mutagenesis of MG14-1 (D23A)
acctggttctgggtatggcgccgggcatcgcctca

SEQ ID NO: 170 - DNA, 18 bp, Artificial Sequence
  Description of Artificial Sequence: Synthetic primer
  Category: primer
  Description: Site-directed mutagenesis of MG14-1 (D23A)
ggcgaggcaagcctaatt

SEQ ID NO: 171 - DNA, 35 bp, Artificial Sequence
  Description of Artificial Sequence: Synthetic primer
  Category: primer
  Description: Site-directed mutagenesis of MG15-1 (D8A)
actatgtgctcggcctggcggtcggtattgcttca

SEQ ID NO: 172 - DNA, 25 bp, Artificial Sequence
  Description of Artificial Sequence: Synthetic primer
  Category: primer
  Description: Site-directed mutagenesis of MG15-1 (D8A)
tcatggtatatctccttcttaaagt

SEQ ID NO: 173 - DNA, 40 bp, Artificial Sequence
  Description of Artificial Sequence: Synthetic primer
  Category: primer
  Description: Site-directed mutagenesis of MG18-1 (D12A)
taaagagtactacattggtctggcgggtggtacggactcg

SEQ ID NO: 174 - DNA, 21 bp, Artificial Sequence
  Description of Artificial Sequence: Synthetic primer
  Category: primer
  Description: Site-directed mutagenesis of MG18-1 (D12A)
ctctggtccatggtatatctc

SEQ ID NO: 175 - DNA, 42 bp, Artificial Sequence
  Description of Artificial Sequence: Synthetic primer
  Category: primer
  Description: Site-directed mutagenesis of SpCas9 (D10A)
gataagaaatactcaataggactggcgattggcacaaatagc

SEQ ID NO: 176 - DNA, 25 bp, Artificial Sequence
  Description of Artificial Sequence: Synthetic primer
  Category: primer
  Description: Site-directed mutagenesis of SpCas9 (D10A)
catggtatatctccttcttaaagtt

SEQ ID NO: 177 - DNA, 21 bp, Artificial Sequence
  Description of Artificial Sequence: Synthetic primer
  Category: primer
  Description: For lacZ sequencing
ccaggctttacactttatgct

SEQ ID NO: 178 - DNA, 19 bp, Artificial Sequence
  Description of Artificial Sequence: Synthetic primer
  Category: primer
  Description: For lacZ sequencing
gtatgtggtggatgaagcc

SEQ ID NO: 179 - DNA, 18 bp, Artificial Sequence
  Description of Artificial Sequence: Synthetic primer
  Category: primer
  Description: Amplify the fragment for nickase assay
agcttccagggggaaacg

SEQ ID NO: 180 - DNA, 26 bp, Artificial Sequence
  Description of Artificial Sequence: Synthetic primer
  Category: primer
  Description: Amplify the fragment for nickase assay
attaacctataaaaataggcgtatca

SEQ ID NO: 181 - DNA, 60 bp, Artificial Sequence
  Description of Artificial Sequence: Synthetic primer
  Category: primer
  Description: Amplify T7 promoter-His tag-adenine deaminase for MGA entry plasmid
gatataccatgggcagcagtcatcatcatcaccatcactccgaggttgaatttagtcatg

SEQ ID NO: 182 - DNA, 60 bp, Artificial Sequence
  Description of Artificial Sequence: Synthetic primer
  Category: primer
  Description: Amplify T7 promoter-His tag-adenine deaminase for MGA entry plasmid
agactttcctcttcttcttgggagacccgccagagcctcgaggacccaccagagctgcct

SEQ ID NO: 183 - DNA, 55 bp, Artificial Sequence
  Description of Artificial Sequence: Synthetic primer
  Category: primer
  Description: Amplify SV40 NLS-vector backbone for MGA entry plasmid
tctggcgggtctcccaagaagaagaggaaagtctaagatccggctgctaacaaag

SEQ ID NO: 184 - DNA, 45 bp, Artificial Sequence
  Description of Artificial Sequence: Synthetic primer
  Category: primer
  Description: Amplify SV40 NLS-vector backbone for MGA entry plasmid
ctccttgcatgctctagaattaattaaaccattccttgcggcggc

SEQ ID NO: 185 - DNA, 48 bp, Artificial Sequence
  Description of Artificial Sequence: Synthetic primer
  Category: primer
  Description: Amplify vector backbone for MGA entry plasmid
aggaatggtttaattaattctagagcatgcaaggagatggcgcccaac

SEQ ID NO: 186 - DNA, 56 bp, Artificial Sequence
  Description of Artificial Sequence: Synthetic primer
  Category: primer
  Description: Amplify vector backbone for MGA entry plasmid
gtgatggtgatgatgatgactgctgcccatggtatatctccttcttaaagttaaac

SEQ ID NO: 187 - DNA, 60 bp, Artificial Sequence
  Description of Artificial Sequence: Synthetic primer
  Category: primer
  Description: Amplify T7 promoter-His-tag-cytosine deaminase for MGC entry plasmid
aggagatataccatgggcagcagtcatcatcatcaccatcacatgtcgtctgagaccggg

SEQ ID NO: 188 - DNA, 60 bp, Artificial Sequence
  Description of Artificial Sequence: Synthetic primer
  Category: primer
  Description: Amplify T7 promoter-His-tag-cytosine deaminase for MGC entry plasmid
taatatctgaaagattggtagaaccaccagacccgcggcagattcaggtgtcgcactttc

SEQ ID NO: 189 - DNA, 44 bp, Artificial Sequence
  Description of Artificial Sequence: Synthetic primer
  Category: primer
  Description: Amplify UGI-SV40 NLS for MGC entry plasmid
cgacacctgaatctgccgcgggtctggtggttctaccaatcttt

SEQ ID NO: 190 - DNA, 60 bp, Artificial Sequence
  Description of Artificial Sequence: Synthetic primer
  Category: primer
  Description: Amplify UGI-SV40 NLS for MGC entry plasmid
ttagactttcctcttcttcttgggagaaccaccagaaagcattttgatcttgttttcgcc

SEQ ID NO: 191 - DNA, 54 bp, Artificial Sequence
  Description of Artificial Sequence: Synthetic primer
  Category: primer
  Description: Amplify SV40 NLS-vector backbone for MGC entry plasmid
ctggtggttctcccaagaagaagaggaaagtctaagatccggctgctaacaaag

SEQ ID NO: 192 - DNA, 45 bp, Artificial Sequence
  Description of Artificial Sequence: Synthetic primer
  Category: primer
  Description: Amplify SV40 NLS-vector backbone for MGC entry plasmid
ctccttgcatgctctagaattaattaaccattccttgcggcggcg

SEQ ID NO: 193 - DNA, 48 bp, Artificial Sequence
  Description of Artificial Sequence: Synthetic primer
  Category: primer
  Description: Amplify vector backbone for MGC entry plasmid
aggaatggttaattaattctagagcatgcaaggagatggcgcccaaca

SEQ ID NO: 194 - DNA, 50 bp, Artificial Sequence
  Description of Artificial Sequence: Synthetic primer
  Category: primer
  Description: Amplify vector backbone for MGC entry plasmid
gtgatgatgatgactgctgcccatggtatatctccttcttaaagttaaac

SEQ ID NO: 195 - DNA, 55 bp, Artificial Sequence
  Description of Artificial Sequence: Synthetic primer
  Category: primer
  Description: Amplify nMG1-4 (D9A) for pMGA expression plasmid
aaagtagtggaggcagctctggtgggtccatgaaaaagaaagttttcgcatttgc

SEQ ID NO: 196 - DNA, 55 bp, Artificial Sequence
  Description of Artificial Sequence: Synthetic primer
  Category: primer
  Description: Amplify nMG1-4 (D9A) for pMGA expression plasmid
ctcttcttcttgggagacccgccagagcctttgctttcgacttttttaaattcgg

SEQ ID NO: 197 - DNA, 54 bp, Artificial Sequence
  Description of Artificial Sequence: Synthetic primer
  Category: primer
  Description: Amplify nMG1-6 (D13A) for pMGA expression plasmid
gaaagtagtggaggcagctctggtgggtccatggagaaagaaaagaacaaccat

SEQ ID NO: 198 - DNA, 50 bp, Artificial Sequence
  Description of Artificial Sequence: Synthetic primer
  Category: primer
  Description: Amplify nMG1-6 (D13A) for pMGA expression plasmid
cctcttcttcttgggagacccgccagagcccagttcacttaactcgacgc

SEQ ID NO: 199 - DNA, 55 bp, Artificial Sequence
  Description of Artificial Sequence: Synthetic primer
  Category: primer
  Description: Amplify nMG3-6 (D13A) for pMGA expression plasmid
gaaagtagtggaggcagctctggtgggtccatgtcaaccgatatgaagaattatc

SEQ ID NO: 200 - DNA, 48 bp, Artificial Sequence
  Description of Artificial Sequence: Synthetic primer
  Category: primer
  Description: Amplify nMG3-6 (D13A) for pMGA expression plasmid
cctcttcttcttgggagacccgccagagcccccctctactccaagcgc

SEQ ID NO: 201 - DNA, 52 bp, Artificial Sequence
  Description of Artificial Sequence: Synthetic primer
  Category: primer
  Description: Amplify nMG3-7 (D12A) for pMGA expression plasmid
gaaagtagtggaggcagctctggtgggtccatgagcgaacatactaagtacc

SEQ ID NO: 202 - DNA, 50 bp, Artificial Sequence
  Description of Artificial Sequence: Synthetic primer
  Category: primer
  Description: Amplify nMG3-7 (D12A) for pMGA expression plasmid
cctcttcttcttgggagacccgccagagccttcttgttcatcaagggctg

SEQ ID NO: 203 - DNA, 54 bp, Artificial Sequence
  Description of Artificial Sequence: Synthetic primer
  Category: primer
  Description: Amplify nMG3-8 (D13A) for pMGA expression plasmid
gaaagtagtggaggcagctctggtgggtccatgagcactgatatgaagaattac

SEQ ID NO: 204 - DNA, 48 bp, Artificial Sequence
  Description of Artificial Sequence: Synthetic primer
  Category: primer
  Description: Amplify nMG3-8 (D13A) for pMGA expression plasmid
cctcttcttcttgggagacccgccagagccaccctcgacgcctaacgc

SEQ ID NO: 205 - DNA, 48 bp, Artificial Sequence
  Description of Artificial Sequence: Synthetic primer
  Category: primer
  Description: Amplify nMG4-5 (D17A) for pMGA expression plasmid
gaaagtagtggaggcagctctggtgggtccatgggagatcagcagacc

SEQ ID NO: 206 - DNA, 48 bp, Artificial Sequence
  Description of Artificial Sequence: Synthetic primer
  Category: primer
  Description: Amplify nMG4-5 (D17A) for pMGA expression plasmid
cctcttcttcttgggagacccgccagagccatcgttcgcgggaaacac

SEQ ID NO: 207 - DNA, 55 bp, Artificial Sequence
  Description of Artificial Sequence: Synthetic primer
  Category: primer
  Description: Amplify nMG14-1 (D23A) for pMGA expression plasmid
gaaagtagtggaggcagctctggtgggtccatggaaattacaattaaccgtgaga

SEQ ID NO: 208 - DNA, 48 bp, Artificial Sequence
  Description of Artificial Sequence: Synthetic primer
  Category: primer
  Description: Amplify nMG14-1 (D23A) for pMGA expression plasmid
cctcttcttcttgggagacccgccagagcccttaatcgggctctcacg

SEQ ID NO: 209 - DNA, 49 bp, Artificial Sequence
  Description of Artificial Sequence: Synthetic primer
  Category: primer
  Description: Amplify nMG15-1 (D8A) for pMGA expression plasmid
gaaagtagtggaggcagctctggtgggtccatgaactatgtgctcggcc

SEQ ID NO: 210 - DNA, 48 bp, Artificial Sequence
  Description of Artificial Sequence: Synthetic primer
  Category: primer
  Description: Amplify nMG15-1 (D8A) for pMGA expression plasmid
cctcttcttcttgggagacccgccagagccacggaacgtttggcgctt

SEQ ID NO: 211 - DNA, 52 bp, Artificial Sequence
  Description of Artificial Sequence: Synthetic primer
  Category: primer
  Description: Amplify nMG18-1 (D12A) for pMGA expression plasmid
gaaagtagtggaggcagctctggtgggtccatggaccagagtaaagagtact

SEQ ID NO: 212 - DNA, 54 bp, Artificial Sequence
  Description of Artificial Sequence: Synthetic primer
  Category: primer
  Description: Amplify nMG18-1 (D12A) for pMGA expression plasmid
cctcttcttcttgggagacccgccagagcccagatcatttaaacacacctcttg

SEQ ID NO: 213 - DNA, 55 bp, Artificial Sequence
  Description of Artificial Sequence: Synthetic primer
  Category: primer
  Description: Amplify SpCas9 (D10A) for pMGA expression plasmid
gaaagtagtggaggcagctctggtgggtccatggataagaaatactcaataggac

SEQ ID NO: 214 - DNA, 48 bp, Artificial Sequence
  Description of Artificial Sequence: Synthetic primer
  Category: primer
  Description: Amplify SpCas9 (D10A) for pMGA expression plasmid
cctcttcttcttgggagacccgccagagccgtcacctcccagctgact

SEQ ID NO: 215 - DNA, 56 bp, Artificial Sequence
  Description of Artificial Sequence: Synthetic primer
  Category: primer
  Description: Amplify nMG1-4 (D9A) for pMGC expression plasmid
acatccgaaagtgcgacacctgaatctgccatgaaaaagaaagttttcgcatttgc

SEQ ID NO: 216 - DNA, 56 bp, Artificial Sequence
  Description of Artificial Sequence: Synthetic primer
  Category: primer
  Description: Amplify nMG1-4 (D9A) for pMGC expression plasmid
atctgaaagattggtagaaccaccagaccctttgctttcgacttttttaaattcgg

SEQ ID NO: 217 - DNA, 54 bp, Artificial Sequence
  Description of Artificial Sequence: Synthetic primer
  Category: primer
  Description: Amplify nMG1-6 (D13A) for pMGC expression plasmid
acatccgaaagtgcgacacctgaatctgccatggagaaagaaaagaacaaccat

SEQ ID NO: 218 - DNA, 50 bp, Artificial Sequence
  Description of Artificial Sequence: Synthetic primer
  Category: primer
  Description: Amplify nMG1-6 (D13A) for pMGC expression plasmid
atctgaaagattggtagaaccaccagaccccagttcacttaactcgacgc

SEQ ID NO: 219 - DNA, 54 bp, Artificial Sequence
  Description of Artificial Sequence: Synthetic primer
  Category: primer
  Description: Amplify nMG3-6 (D13A) for pMGC expression plasmid
catccgaaagtgcgacacctgaatctgccatgtcaaccgatatgaagaattatc

SEQ ID NO: 220 - DNA, 48 bp, Artificial Sequence
  Description of Artificial Sequence: Synthetic primer
  Category: primer
  Description: Amplify nMG3-6 (D13A) for pMGC expression plasmid
atctgaaagattggtagaaccaccagaccccccctctactccaagcgc

SEQ ID NO: 221 - DNA, 52 bp, Artificial Sequence
  Description of Artificial Sequence: Synthetic primer
  Category: primer
  Description: Amplify nMG3-7 (D12A) for pMGC expression plasmid
acatccgaaagtgcgacacctgaatctgccatgagcgaacatactaagtacc

SEQ ID NO: 222 - DNA, 50 bp, Artificial Sequence
  Description of Artificial Sequence: Synthetic primer
  Category: primer
  Description: Amplify nMG3-7 (D12A) for pMGC expression plasmid
atctgaaagattggtagaaccaccagacccttcttgttcatcaagggctg

SEQ ID NO: 223 - DNA, 54 bp, Artificial Sequence
  Description of Artificial Sequence: Synthetic primer
  Category: primer
  Description: Amplify nMG3-8 (D13A) for pMGC expression plasmid
acatccgaaagtgcgacacctgaatctgccatgagcactgatatgaagaattac

SEQ ID NO: 224 - DNA, 48 bp, Artificial Sequence
  Description of Artificial Sequence: Synthetic primer
  Category: primer
  Description: Amplify nMG3-8 (D13A) for pMGC expression plasmid
atctgaaagattggtagaaccaccagacccaccctcgacgcctaacgc

SEQ ID NO: 225 - DNA, 48 bp, Artificial Sequence
  Description of Artificial Sequence: Synthetic primer
  Category: primer
  Description: Amplify nMG4-5 (D17A) for pMGC expression plasmid
acatccgaaagtgcgacacctgaatctgccatgggagatcagcagacc

SEQ ID NO: 226 - DNA, 48 bp, Artificial Sequence
  Description of Artificial Sequence: Synthetic primer
  Category: primer
  Description: Amplify nMG4-5 (D17A) for pMGC expression plasmid
atctgaaagattggtagaaccaccagacccatcgttcgcgggaaacac

SEQ ID NO: 227 - DNA, 54 bp, Artificial Sequence
  Description of Artificial Sequence: Synthetic primer
  Category: primer
  Description: Amplify nMG14-1 (D23A) for pMGC expression plasmid
acatccgaaagtgcgacacctgaatctgccatggaaattacaattaaccgtgag

SEQ ID NO: 228 - DNA, 49 bp, Artificial Sequence
  Description of Artificial Sequence: Synthetic primer
  Category: primer
  Description: Amplify nMG14-1 (D23A) for pMGC expression plasmid
atctgaaagattggtagaaccaccagaccccttaatcgggctctcacga

SEQ ID NO: 229 - DNA, 49 bp, Artificial Sequence
  Description of Artificial Sequence: Synthetic primer
  Category: primer
  Description: Amplify nMG15-1 (D8A) for pMGC expression plasmid
acatccgaaagtgcgacacctgaatctgccatgaactatgtgctcggcc

SEQ ID NO: 230 - DNA, 48 bp, Artificial Sequence
  Description of Artificial Sequence: Synthetic primer
  Category: primer
  Description: Amplify nMG15-1 (D8A) for pMGC expression plasmid
atctgaaagattggtagaaccaccagacccacggaacgtttggcgctt

SEQ ID NO: 231 - DNA, 49 bp, Artificial Sequence
  Description of Artificial Sequence: Synthetic primer
  Category: primer
  Description: Amplify nMG18-1 (D12A) for pMGC expression plasmid
atccgaaagtgcgacacctgaatctgccatggaccagagtaaagagtac

SEQ ID NO: 232 - DNA, 55 bp, Artificial Sequence
  Description of Artificial Sequence: Synthetic primer
  Category: primer
  Description: Amplify nMG18-1 (D12A) for pMGC expression plasmid
tatctgaaagattggtagaaccaccagaccccagatcatttaaacacacctcttg

SEQ ID NO: 233 - DNA, 55 bp, Artificial Sequence
  Description of Artificial Sequence: Synthetic primer
  Category: primer
  Description: Amplify SpCas9 (D10A) for pMGC expression plasmid
acatccgaaagtgcgacacctgaatctgccatggataagaaatactcaataggac

SEQ ID NO: 234 - DNA, 48 bp, Artificial Sequence
  Description of Artificial Sequence: Synthetic primer
  Category: primer
  Description: Amplify SpCas9 (D10A) for pMGC expression plasmid
atctgaaagattggtagaaccaccagacccgtcacctcccagctgact

SEQ ID NO: 235 - DNA, 44 bp, Artificial Sequence
  Description of Artificial Sequence: Synthetic primer
  Category: primer
  Description: Amplify MGA1-4_sgRNA spacer 1
ggtcaaattcagacggcaaacgctatagtgagtcgtattaaggt

SEQ ID NO: 236 - DNA, 50 bp, Artificial Sequence
  Description of Artificial Sequence: Synthetic primer
  Category: primer
  Description: Amplify MGA1-4_sgRNA spacer 1
tatagcgtttgccgtctgaatttgaccgttttgatttactcgaaagagtc

SEQ ID NO: 237 - DNA, 50 bp, Artificial Sequence
  Description of Artificial Sequence: Synthetic primer
  Category: primer
  Description: Amplify MGA1-4_sgRNA spacer 2
caaaactccgccacatatcctgatcttcctatagtgagtcgtattaaggt

SEQ ID NO: 238 - DNA, 50 bp, Artificial Sequence
  Description of Artificial Sequence: Synthetic primer
  Category: primer
  Description: Amplify MGA1-4_sgRNA spacer 2
tataggaagatcaggatatgtggcggagttttgatttactcgaaagagtc

SEQ ID NO: 239 - DNA, 50 bp, Artificial Sequence
  Description of Artificial Sequence: Synthetic primer
  Category: primer
  Description: Amplify MGA1-4_sgRNA spacer 3
caaaacccataaagaaactgttacccgtctatagtgagtcgtattaaggt

SEQ ID NO: 240 - DNA, 50 bp, Artificial Sequence
  Description of Artificial Sequence: Synthetic primer
  Category: primer
  Description: Amplify MGA1-4_sgRNA spacer 3
tatagacgggtaacagtttctttatgggttttgatttactcgaaagagtc

SEQ ID NO: 241 - DNA, 50 bp, Artificial Sequence
  Description of Artificial Sequence: Synthetic primer
  Category: primer
  Description: Amplify MGA1-6_sgRNA spacer 1
caaaacgtagtcggtttatgcagcaacgctatagtgagtcgtattaaggt

SEQ ID NO: 242 - DNA, 50 bp, Artificial Sequence
  Description of Artificial Sequence: Synthetic primer
  Category: primer
  Description: Amplify MGA1-6_sgRNA spacer 1
tagcgttgctgcataaaccgactacgttttgacttgaaaaagtcttaact

SEQ ID NO: 243 - DNA, 50 bp, Artificial Sequence
  Description of Artificial Sequence: Synthetic primer
  Category: primer
  Description: Amplify MGA1-6_sgRNA spacer 2
caaaacgcgctccacagtttcgggttttctatagtgagtcgtattaaggt

SEQ ID NO: 244 - DNA, 50 bp, Artificial Sequence
  Description of Artificial Sequence: Synthetic primer
  Category: primer
  Description: Amplify MGA1-6_sgRNA spacer 2
tagaaaacccgaaactgtggagcgcgttttgacttgaaaaagtcttaact

SEQ ID NO: 245 - DNA, 50 bp, Artificial Sequence
  Description of Artificial Sequence: Synthetic primer
  Category: primer
  Description: Amplify MGA1-6_sgRNA spacer 3
caaaaccagcagcagaccattttcaatcctatagtgagtcgtattaaggt

SEQ ID NO: 246 - DNA, 50 bp, Artificial Sequence
  Description of Artificial Sequence: Synthetic primer
  Category: primer
  Description: Amplify MGA1-6_sgRNA spacer 3
taggattgaaaatggtctgctgctggttttgacttgaaaaagtcttaact

SEQ ID NO: 247 - DNA, 50 bp, Artificial Sequence
  Description of Artificial Sequence: Synthetic primer
  Category: primer
  Description: Amplify MGA3-6_sgRNA spacer 1
ctcaaccataaagaaactgttacccgtactatagtgagtcgtattaaggt

SEQ ID NO: 248 - DNA, 50 bp, Artificial Sequence
  Description of Artificial Sequence: Synthetic primer
  Category: primer
  Description: Amplify MGA3-6_sgRNA spacer 1
atagtacgggtaacagtttctttatggttgagaatcgaaagattcttaat

SEQ ID NO: 249 - DNA, 50 bp, Artificial Sequence
  Description of Artificial Sequence: Synthetic primer
  Category: primer
  Description: Amplify MGA3-6_sgRNA spacer 2
ctcaacctggcggttaaattgccaacgcctatagtgagtcgtattaaggt

SEQ ID NO: 250 - DNA, 50 bp, Artificial Sequence
  Description of Artificial Sequence: Synthetic primer
  Category: primer
  Description: Amplify MGA3-6_sgRNA spacer 2
taggcgttggcaatttaaccgccaggttgagaatcgaaagattcttaata

SEQ ID NO: 251 - DNA, 50 bp, Artificial Sequence
  Description of Artificial Sequence: Synthetic primer
  Category: primer
  Description: Amplify MGA3-6_sgRNA spacer 3
ctcaactatggaaaccgtcgatattcagctatagtgagtcgtattaaggt

SEQ ID NO: 252 - DNA, 50 bp, Artificial Sequence
  Description of Artificial Sequence: Synthetic primer
  Category: primer
  Description: Amplify MGA3-6_sgRNA spacer 3
tagctgaatatcgacggtttccatagttgagaatcgaaagattcttaata

SEQ ID NO: 253 - DNA, 50 bp, Artificial Sequence
  Description of Artificial Sequence: Synthetic primer
  Category: primer
  Description: Amplify MGA3-7_sgRNA spacer 1
cccaacgctttcatcaacattaaatgtgctatagtgagtcgtattaaggt

SEQ ID NO: 254 - DNA, 50 bp, Artificial Sequence
  Description of Artificial Sequence: Synthetic primer
  Category: primer
  Description: Amplify MGA3-7_sgRNA spacer 1
tcactatagcacatttaatgttgatgaaagcgttgggaaccgaaaggttc

SEQ ID NO: 255 - DNA, 50 bp, Artificial Sequence
  Description of Artificial Sequence: Synthetic primer
  Category: primer
  Description: Amplify MGA3-7_sgRNA spacer 2
cccaaccatggaaatcgctgatttgtgtctatagtgagtcgtattaaggt

SEQ ID NO: 256 - DNA, 50 bp, Artificial Sequence
  Description of Artificial Sequence: Synthetic primer
  Category: primer
  Description: Amplify MGA3-7_sgRNA spacer 2
tcactatagacacaaatcagcgatttccatggttgggaaccgaaaggttc

SEQ ID NO: 257 - DNA, 50 bp, Artificial Sequence
  Description of Artificial Sequence: Synthetic primer
  Category: primer
  Description: Amplify MGA3-7_sgRNA spacer 3
cccaacgcaccatcgtctgctcatccatctatagtgagtcgtattaaggt

SEQ ID NO: 258 - DNA, 50 bp, Artificial Sequence
  Description of Artificial Sequence: Synthetic primer
  Category: primer
  Description: Amplify MGA3-7_sgRNA spacer 3
tcactatagatggatgagcagacgatggtgcgttgggaaccgaaaggttc

SEQ ID NO: 259 - DNA, 50 bp, Artificial Sequence
  Description of Artificial Sequence: Synthetic primer
  Category: primer
  Description: Amplify MGA4-5_sgRNA spacer 1
cacagcacatggaaatcgctgatttgtgctatagtgagtcgtattaaggt

SEQ ID NO: 260 - DNA, 48 bp, Artificial Sequence
  Description of Artificial Sequence: Synthetic primer
  Category: primer
  Description: Amplify MGA4-5_sgRNA spacer 1
cactatagcacaaatcagcgatttccatgtgctgtggcttgcggggga

SEQ ID NO: 261 - DNA, 50 bp, Artificial Sequence
  Description of Artificial Sequence: Synthetic primer
  Category: primer
  Description: Amplify MGA4-5_sgRNA spacer 2
cacagcttaaagttgttctgcttcatcactatagtgagtcgtattaaggt

SEQ ID NO: 262 - DNA, 48 bp, Artificial Sequence
  Description of Artificial Sequence: Synthetic primer
  Category: primer
  Description: Amplify MGA4-5_sgRNA spacer 2
cactatagtgatgaagcagaacaactttaagctgtggcttgcggggga

SEQ ID NO: 263 - DNA, 50 bp, Artificial Sequence
  Description of Artificial Sequence: Synthetic primer
  Category: primer
  Description: Amplify MGA4-5_sgRNA spacer 3
cacagcccatgccgtgggtttcaatattctatagtgagtcgtattaaggt

SEQ ID NO: 264 - DNA, 48 bp, Artificial Sequence
  Description of Artificial Sequence: Synthetic primer
  Category: primer
  Description: Amplify MGA4-5_sgRNA spacer 3
cactatagaatattgaaacccacggcatgggctgtggcttgcggggga

SEQ ID NO: 265 - DNA, 50 bp, Artificial Sequence
  Description of Artificial Sequence: Synthetic primer
  Category: primer
  Description: Amplify MGA14-1_sgRNA spacer 1
caagacggtagcgaaagccattttttgactatagtgagtcgtattaaggt

SEQ ID NO: 266 - DNA, 48 bp, Artificial Sequence
  Description of Artificial Sequence: Synthetic primer
  Category: primer
  Description: Amplify MGA14-1_sgRNA spacer 1
cactatagtcaaaaaatggctttcgctaccgtcttgagcgaaagctcc

SEQ ID NO: 267 - DNA, 50 bp, Artificial Sequence
  Description of Artificial Sequence: Synthetic primer
  Category: primer
  Description: Amplify MGA14-1_sgRNA spacer 2
caagacgtgcactgcaacaacgctgcttctatagtgagtcgtattaaggt

SEQ ID NO: 268 - DNA, 48 bp, Artificial Sequence
  Description of Artificial Sequence: Synthetic primer
  Category: primer
  Description: Amplify MGA14-1_sgRNA spacer 2
cactatagaagcagcgttgttgcagtgcacgtcttgagcgaaagctcc

SEQ ID NO: 269 - DNA, 50 bp, Artificial Sequence
  Description of Artificial Sequence: Synthetic primer
  Category: primer
  Description: Amplify MGA14-1_sgRNA spacer 3
caagacatccggtaggttttccggctgactatagtgagtcgtattaaggt

SEQ ID NO: 270 - DNA, 48 bp, Artificial Sequence
  Description of Artificial Sequence: Synthetic primer
  Category: primer
  Description: Amplify MGA14-1_sgRNA spacer 3
cactatagtcagccggaaaacctaccggatgtcttgagcgaaagctcc

SEQ ID NO: 271 - DNA, 50 bp, Artificial Sequence
  Description of Artificial Sequence: Synthetic primer
  Category: primer
  Description: Amplify MGA15-1_sgRNA spacer 1
tacaactccgccacatatcctgatcttcctatagtgagtcgtattaaggt

SEQ ID NO: 272 - DNA, 50 bp, Artificial Sequence
  Description of Artificial Sequence: Synthetic primer
  Category: primer
  Description: Amplify MGA15-1_sgRNA spacer 1
tataggaagatcaggatatgtggcggagttgtaattccctagaaataggt

SEQ ID NO: 273 - DNA, 50 bp, Artificial Sequence
  Description of Artificial Sequence: Synthetic primer
  Category: primer
  Description: Amplify MGA15-1_sgRNA spacer 2
tacaacacagtttcgggttttcgacgttctatagtgagtcgtattaaggt

SEQ ID NO: 274 - DNA, 50 bp, Artificial Sequence
  Description of Artificial Sequence: Synthetic primer
  Category: primer
  Description: Amplify MGA15-1_sgRNA spacer 2
tatagaacgtcgaaaacccgaaactgtgttgtaattccctagaaataggt

SEQ ID NO: 275 - DNA, 50 bp, Artificial Sequence
  Description of Artificial Sequence: Synthetic primer
  Category: primer
  Description: Amplify MGA15-1_sgRNA spacer 3
tacaacattggcaccatgccgtgggtttctatagtgagtcgtattaaggt

SEQ ID NO: 276 - DNA, 50 bp, Artificial Sequence
  Description of Artificial Sequence: Synthetic primer
  Category: primer
  Description: Amplify MGA15-1_sgRNA spacer 3
tatagaaacccacggcatggtgccaatgttgtaattccctagaaataggt

SEQ ID NO: 277 - DNA, 50 bp, Artificial Sequence
  Description of Artificial Sequence: Synthetic primer
  Category: primer
  Description: Amplify MGA18-1_sgRNA spacer 1
tcaaacgcgctccacagtttcgggttttctatagtgagtcgtattaaggt

SEQ ID NO: 278 - DNA, 50 bp, Artificial Sequence
  Description of Artificial Sequence: Synthetic primer
  Category: primer
  Description: Amplify MGA18-1_sgRNA spacer 1
tatagaaaacccgaaactgtggagcgcgtttgagagtagtgaaaactacg

SEQ ID NO: 279 - DNA, 50 bp, Artificial Sequence
  Description of Artificial Sequence: Synthetic primer
  Category: primer
  Description: Amplify MGA18-1_sgRNA spacer 2
tcaaaccgtactgtgagccagagttgccctatagtgagtcgtattaaggt

SEQ ID NO: 280 - DNA, 50 bp, Artificial Sequence
  Description of Artificial Sequence: Synthetic primer
  Category: primer
  Description: Amplify MGA18-1_sgRNA spacer 2
tatagggcaactctggctcacagtacggtttgagagtagtgaaaactacg

SEQ ID NO: 281 - DNA, 50 bp, Artificial Sequence
  Description of Artificial Sequence: Synthetic primer
  Category: primer
  Description: Amplify MGA18-1_sgRNA spacer 3
tcaaacatcaatccggtaggttttccggctatagtgagtcgtattaaggt

SEQ ID NO: 282 - DNA, 50 bp, Artificial Sequence
  Description of Artificial Sequence: Synthetic primer
  Category: primer
  Description: Amplify MGA18-1_sgRNA spacer 3
tatagccggaaaacctaccggattgatgtttgagagtagtgaaaactacg

SEQ ID NO: 283 - DNA, 41 bp, Artificial Sequence
  Description of Artificial Sequence: Synthetic primer
  Category: primer
  Description: Amplify ABE8.17m_sgRNA spacer 1
atccacatctgtgaaagaaactatagtgagtcgtattagga

SEQ ID NO: 284 - DNA, 45 bp, Artificial Sequence
  Description of Artificial Sequence: Synthetic primer
  Category: primer
  Description: Amplify ABE8.17m_sgRNA spacer 1
tttctttcacagatgtggatgttttagagctagaaatagcaagtt

SEQ ID NO: 285 - DNA, 41 bp, Artificial Sequence
  Description of Artificial Sequence: Synthetic primer
  Category: primer
  Description: Amplify ABE8.17m_sgRNA spacer 2
ctcatccgccacatatcctgctatagtgagtcgtattagga

SEQ ID NO: 286 - DNA, 45 bp, Artificial Sequence
  Description of Artificial Sequence: Synthetic primer
  Category: primer
  Description: Amplify ABE8.17m_sgRNA spacer 2
caggatatgtggcggatgaggttttagagctagaaatagcaagtt

SEQ ID NO: 287 - DNA, 41 bp, Artificial Sequence
  Description of Artificial Sequence: Synthetic primer
  Category: primer
  Description: Amplify ABE8.17m_sgRNA spacer 3
atcgcgtgggcgtattcgcactatagtgagtcgtattagga

SEQ ID NO: 288 - DNA, 45 bp, Artificial Sequence
  Description of Artificial Sequence: Synthetic primer
  Category: primer
  Description: Amplify ABE8.17m_sgRNA spacer 3
tgcgaatacgcccacgcgatgttttagagctagaaatagcaagtt

SEQ ID NO: 289 - DNA, 50 bp, Artificial Sequence
  Description of Artificial Sequence: Synthetic primer
  Category: primer
  Description: Amplify MGC1-4_spacer 1
caaaacttgcaccacagatgaaacgccgctatagtgagtcgtattaaggt

SEQ ID NO: 290 - DNA, 50 bp, Artificial Sequence
  Description of Artificial Sequence: Synthetic primer
  Category: primer
  Description: Amplify MGC1-4_spacer 1
tatagcggcgtttcatctgtggtgcaagttttgatttactcgaaagagtc

SEQ ID NO: 291 - DNA, 50 bp, Artificial Sequence
  Description of Artificial Sequence: Synthetic primer
  Category: primer
  Description: Amplify MGC1-4_spacer 2
caaaacgacggcaaacgactgtcctggcctatagtgagtcgtattaaggt

SEQ ID NO: 292 - DNA, 50 bp, Artificial Sequence
  Description of Artificial Sequence: Synthetic primer
  Category: primer
  Description: Amplify MGC1-4_spacer 2
tataggccaggacagtcgtttgccgtcgttttgatttactcgaaagagtc

SEQ ID NO: 293 - DNA, 50 bp, Artificial Sequence
  Description of Artificial Sequence: Synthetic primer
  Category: primer
  Description: Amplify MGC1-4_spacer 3
caaaacgcctccagtacagcgcggctgactatagtgagtcgtattaaggt

SEQ ID NO: 294 - DNA, 50 bp, Artificial Sequence
  Description of Artificial Sequence: Synthetic primer
  Category: primer
  Description: Amplify MGC1-4_spacer 3
tatagtcagccgcgctgtactggaggcgttttgatttactcgaaagagtc

SEQ ID NO: 295 - DNA, 50 bp, Artificial Sequence
  Description of Artificial Sequence: Synthetic primer
  Category: primer
  Description: Amplify MGC1-6_spacer 1
caaaacgctgcgcaactgttgggaagggctatagtgagtcgtattaaggt

SEQ ID NO: 296 - DNA, 50 bp, Artificial Sequence
  Description of Artificial Sequence: Synthetic primer
  Category: primer
  Description: Amplify MGC1-6_spacer 1
tagcccttcccaacagttgcgcagcgttttgacttgaaaaagtcttaact

SEQ ID NO: 297 - DNA, 50 bp, Artificial Sequence
  Description of Artificial Sequence: Synthetic primer
  Category: primer
  Description: Amplify MGC1-6_spacer 2
caaaaccagtttgaggggacgacgacagctatagtgagtcgtattaaggt

SEQ ID NO: 298 - DNA, 50 bp, Artificial Sequence
  Description of Artificial Sequence: Synthetic primer
  Category: primer
  Description: Amplify MGC1-6_spacer 2
tagctgtcgtcgtcccctcaaactggttttgacttgaaaaagtcttaact

SEQ ID NO: 299 - DNA, 50 bp, Artificial Sequence
  Description of Artificial Sequence: Synthetic primer
  Category: primer
  Description: Amplify MGC1-6_spacer 3
caaaacggttttcgacgttcagacgtagctatagtgagtcgtattaaggt

SEQ ID NO: 300 - DNA, 50 bp, Artificial Sequence
  Description of Artificial Sequence: Synthetic primer
  Category: primer
  Description: Amplify MGC1-6_spacer 3
tagctacgtctgaacgtcgaaaaccgttttgacttgaaaaagtcttaact

SEQ ID NO: 301 - DNA, 50 bp, Artificial Sequence
  Description of Artificial Sequence: Synthetic primer
  Category: primer
  Description: Amplify MGC3-6_spacer 1
ctcaactcttccagataactgccgtcacctatagtgagtcgtattaaggt

SEQ ID NO: 302 - DNA, 50 bp, Artificial Sequence
  Description of Artificial Sequence: Synthetic primer
  Category: primer
  Description: Amplify MGC3-6_spacer 1
aggtgacggcagttatctggaagagttgagaatcgaaagattcttaataa

SEQ ID NO: 303 - DNA, 50 bp, Artificial Sequence
  Description of Artificial Sequence: Synthetic primer
  Category: primer
  Description: Amplify MGC3-6_spacer 2
tcaacagtacagcgcggctgaaatcatctatagtgagtcgtattaaggtc

SEQ ID NO: 304 - DNA, 50 bp, Artificial Sequence
  Description of Artificial Sequence: Synthetic primer
  Category: primer
  Description: Amplify MGC3-6_spacer 2
agatgatttcagccgcgctgtactgttgagaatcgaaagattcttaataa

SEQ ID NO: 305 - DNA, 50 bp, Artificial Sequence
  Description of Artificial Sequence: Synthetic primer
  Category: primer
  Description: Amplify MGC3-6_spacer 3
ctcaaccggtcaaaacaggcggcagtaactatagtgagtcgtattaaggt

SEQ ID NO: 306 - DNA, 50 bp, Artificial Sequence
  Description of Artificial Sequence: Synthetic primer
  Category: primer
  Description: Amplify MGC3-6_spacer 3
tagttactgccgcctgttttgaccggttgagaatcgaaagattcttaata

SEQ ID NO: 307 - DNA, 50 bp, Artificial Sequence
  Description of Artificial Sequence: Synthetic primer
  Category: primer
  Description: Amplify MGC3-7_spacer 1
cccaacaaaccaggcaaagcgccattcgctatagtgagtcgtattaaggt

SEQ ID NO: 308 - DNA, 49 bp, Artificial Sequence
  Description of Artificial Sequence: Synthetic primer
  Category: primer
  Description: Amplify MGC3-7_spacer 1
cactatagcgaatggcgctttgcctggtttgttgggaaccgaaaggttc

SEQ ID NO: 309 - DNA, 50 bp, Artificial Sequence
  Description of Artificial Sequence: Synthetic primer
  Category: primer
  Description: Amplify MGC3-7_spacer 2
cccaactgcatctgccagtttgaggggactatagtgagtcgtattaaggt

SEQ ID NO: 310 - DNA, 49 bp, Artificial Sequence
  Description of Artificial Sequence: Synthetic primer
  Category: primer
  Description: Amplify MGC3-7_spacer 2
cactatagtcccctcaaactggcagatgcagttgggaaccgaaaggttc

SEQ ID NO: 311 - DNA, 50 bp, Artificial Sequence
  Description of Artificial Sequence: Synthetic primer
  Category: primer
  Description: Amplify MGC3-7_spacer 3
cccaacgataggtcacgttggtgtagatctatagtgagtcgtattaaggt

SEQ ID NO: 312 - DNA, 49 bp, Artificial Sequence
  Description of Artificial Sequence: Synthetic primer
  Category: primer
  Description: Amplify MGC3-7_spacer 3
cactatagatctacaccaacgtgacctatcgttgggaaccgaaaggttc

SEQ ID NO: 313 - DNA, 50 bp, Artificial Sequence
  Description of Artificial Sequence: Synthetic primer
  Category: primer
  Description: Amplify MGC4-5_spacer 1
cacagcgtaaccgacccagcgcccgttgctatagtgagtcgtattaaggt

SEQ ID NO: 314 - DNA, 48 bp, Artificial Sequence
  Description of Artificial Sequence: Synthetic primer
  Category: primer
  Description: Amplify MGC4-5_spacer 1
cactatagcaacgggcgctgggtcggttacgctgtggcttgcggggga

SEQ ID NO: 315 - DNA, 50 bp, Artificial Sequence; identical to SEQ ID NO: 259
  Description of Artificial Sequence: Synthetic primer
  Category: primer
  Description: Amplify MGC4-5_spacer 2

SEQ ID NO: 316 - DNA, 48 bp, Artificial Sequence; identical to SEQ ID NO: 260
  Description of Artificial Sequence: Synthetic primer
  Category: primer
  Description: Amplify MGC4-5_spacer 2

SEQ ID NO: 317 - DNA, 50 bp, Artificial Sequence
  Description of Artificial Sequence: Synthetic primer
  Category: primer
  Description: Amplify MGC4-5_spacer 3
cacagcgtggtgtcggctccgccgccttctatagtgagtcgtattaaggt

SEQ ID NO: 318 - DNA, 48 bp, Artificial Sequence
  Description of Artificial Sequence: Synthetic primer
  Category: primer
  Description: Amplify MGC4-5_spacer 3
cactatagaaggcggcggagccgacaccacgctgtggcttgcggggga

SEQ ID NO: 319 - DNA, 50 bp, Artificial Sequence
  Description of Artificial Sequence: Synthetic primer
  Category: primer
  Description: Amplify MGC14-1_spacer 1
caagacggaacaaacggcggattgaccgctatagtgagtcgtattaaggt

SEQ ID NO: 320 - DNA, 48 bp, Artificial Sequence
  Description of Artificial Sequence: Synthetic primer
  Category: primer
  Description: Amplify MGC14-1_spacer 1
cactatagcggtcaatccgccgtttgttccgtcttgagcgaaagctcc

SEQ ID NO: 321 - DNA, 50 bp, Artificial Sequence
  Description of Artificial Sequence: Synthetic primer
  Category: primer
  Description: Amplify MGC14-1_spacer 2
caagacgcgtgggcgtattcgcaaaggactatagtgagtcgtattaaggt

SEQ ID NO: 322 - DNA, 48 bp, Artificial Sequence
  Description of Artificial Sequence: Synthetic primer
  Category: primer
  Description: Amplify MGC14-1_spacer 2
cactatagtcctttgcgaatacgcccacgcgtcttgagcgaaagctcc

SEQ ID NO: 323 - DNA, 50 bp, Artificial Sequence
  Description of Artificial Sequence: Synthetic primer
  Category: primer
  Description: Amplify MGC14-1_spacer 3
caagacaaatcaccgccgtaagccgaccctatagtgagtcgtattaaggt

SEQ ID NO: 324 - DNA, 48 bp, Artificial Sequence
  Description of Artificial Sequence: Synthetic primer
  Category: primer
  Description: Amplify MGC14-1_spacer 3
cactatagggtcggcttacggcggtgatttgtcttgagcgaaagctcc

SEQ ID NO: 325 - DNA, 50 bp, Artificial Sequence
  Description of Artificial Sequence: Synthetic primer
  Category: primer
  Description: Amplify MGC15-1_spacer 1
tacaacgacgtagtgtgacgcgatcggcctatagtgagtcgtattaaggt

SEQ ID NO: 326 - DNA, 50 bp, Artificial Sequence
  Description of Artificial Sequence: Synthetic primer
  Category: primer
  Description: Amplify MGC15-1_spacer 1
ataggccgatcgcgtcacactacgtcgttgtaattccctagaaataggtt

SEQ ID NO: 327 - DNA, 50 bp, Artificial Sequence
  Description of Artificial Sequence: Synthetic primer
  Category: primer
  Description: Amplify MGC15-1_spacer 2
tacaactcgccggtagccagcgcggatcctatagtgagtcgtattaaggt

SEQ ID NO: 328 - DNA, 50 bp, Artificial Sequence
  Description of Artificial Sequence: Synthetic primer
  Category: primer
  Description: Amplify MGC15-1_spacer 2
ataggatccgcgctggctaccggcgagttgtaattccctagaaataggtt

SEQ ID NO: 329 - DNA, 50 bp, Artificial Sequence
  Description of Artificial Sequence: Synthetic primer
  Category: primer
  Description: Amplify MGC15-1_spacer 3
tacaaccatactgcaccgggcgggaaggctatagtgagtcgtattaaggt

SEQ ID NO: 330 - DNA, 50 bp, Artificial Sequence
  Description of Artificial Sequence: Synthetic primer
  Category: primer
  Description: Amplify MGC15-1_spacer 3
atagccttcccgcccggtgcagtatggttgtaattccctagaaataggtt

SEQ ID NO: 331 - DNA, 50 bp, Artificial Sequence
  Description of Artificial Sequence: Synthetic primer
  Category: primer
  Description: Amplify MGC18-1_spacer 1
tcaaacgcctccagtacagcgcggctgactatagtgagtcgtattaaggt

SEQ ID NO: 332 - DNA, 50 bp, Artificial Sequence
  Description of Artificial Sequence: Synthetic primer
  Category: primer
  Description: Amplify MGC18-1_spacer 1
ctatagtcagccgcgctgtactggaggcgtttgagagtagtgaaaactac

SEQ ID NO: 333 - DNA, 50 bp, Artificial Sequence
  Description of Artificial Sequence: Synthetic primer
  Category: primer
  Description: Amplify MGC18-1_spacer 2
tcaaacgcacagccgggaagggctggtcctatagtgagtcgtattaaggt

SEQ ID NO: 334 - DNA, 50 bp, Artificial Sequence
  Description of Artificial Sequence: Synthetic primer
  Category: primer
  Description: Amplify MGC18-1_spacer 2
ctataggaccagcccttcccggctgtgcgtttgagagtagtgaaaactac

SEQ ID NO: 335 - DNA, 50 bp, Artificial Sequence
  Description of Artificial Sequence: Synthetic primer
  Category: primer
  Description: Amplify MGC18-1_spacer 3
tcaaacatggtttgcccggataaacggactatagtgagtcgtattaaggt

SEQ ID NO: 336 - DNA, 50 bp, Artificial Sequence
  Description of Artificial Sequence: Synthetic primer
  Category: primer
  Description: Amplify MGC18-1_spacer 3
ctatagtccgtttatccgggcaaaccatgtttgagagtagtgaaaactac

SEQ ID NO: 337 - DNA, 41 bp, Artificial Sequence
  Description of Artificial Sequence: Synthetic primer
  Category: primer
  Description: Amplify BE3_sgRNA spacer 1
tgtggagcgacatccagaggctatagtgagtcgtattagga

SEQ ID NO: 338 - DNA, 45 bp, Artificial Sequence
  Description of Artificial Sequence: Synthetic primer
  Category: primer
  Description: Amplify BE3_sgRNA spacer 1
cctctggatgtcgctccacagttttagagctagaaatagcaagtt

SEQ ID NO: 339 - DNA, 41 bp, Artificial Sequence
  Description of Artificial Sequence: Synthetic primer
  Category: primer
  Description: Amplify BE3_sgRNA spacer 2
taattcaattcgcgcgtcccctatagtgagtcgtattagga

SEQ ID NO: 340 - DNA, 45 bp, Artificial Sequence
  Description of Artificial Sequence: Synthetic primer
  Category: primer
  Description: Amplify BE3_sgRNA spacer 2
gggacgcgcgaattgaattagttttagagctagaaatagcaagtt

SEQ ID NO: 341 - DNA, 41 bp, Artificial Sequence
  Description of Artificial Sequence: Synthetic primer
  Category: primer
  Description: Amplify BE3_sgRNA spacer 3
agtcacgacgttgtaaaacgctatagtgagtcgtattagga

SEQ ID NO: 342 - DNA, 45 bp, Artificial Sequence
  Description of Artificial Sequence: Synthetic primer
  Category: primer
  Description: Amplify BE3_sgRNA spacer 3
cgttttacaacgtcgtgactgttttagagctagaaatagcaagtt

SEQ ID NO: 343 - DNA, 25 bp, Artificial Sequence
  Description of Artificial Sequence: Synthetic primer
  Category: primer
  Description: For lacZ sequencing
cgaacatccaaaagtttgtgttttt

SEQ ID NO: 344 - DNA, 19 bp, Artificial Sequence
  Description of Artificial Sequence: Synthetic primer
  Category: primer
  Description: For lacZ sequencing
tgagcgcatttttacgcgc

SEQ ID NO: 345 - DNA, 18 bp, Artificial Sequence
  Description of Artificial Sequence: Synthetic primer
  Category: primer
  Description: For lacZ sequencing
gaaaacggcaacccgtgg

SEQ ID NO: 346 - DNA, 50 bp, Artificial Sequence
  Description of Artificial Sequence: Synthetic primer
  Category: primer
  Description: Amplify sgRNA expression cassette
ccgccgccgcaaggaatggtttaattaattacggccagtcatgcataatc

SEQ ID NO: 347 - DNA, 50 bp, Artificial Sequence
  Description of Artificial Sequence: Synthetic primer
  Category: primer
  Description: Amplify sgRNA expression cassette
gactgttgggcgccatctccttgcatgctcactgagcctccacctagcct

SEQ ID NO: 348 - DNA, 50 bp, Artificial Sequence
  Description of Artificial Sequence: Synthetic primer
  Category: primer
  Description: Amplify MGA3-8_sgRNA spacer 1
ctcaaccgcccgttgcaccacagatgaactatagtgagtcgtattaaggt

SEQ ID NO: 349 - DNA, 50 bp, Artificial Sequence
  Description of Artificial Sequence: Synthetic primer
  Category: primer
  Description: Amplify MGA3-8_sgRNA spacer 1
tatagttcatctgtggtgcaacgggcggttgagaatctttcgaaagaaag

SEQ ID NO: 350 - DNA, 50 bp, Artificial Sequence
  Description of Artificial Sequence: Synthetic primer
  Category: primer
  Description: Amplify MGA3-8_sgRNA spacer 2
ctcaacccatgcagaggatgatgctcgtctatagtgagtcgtattaaggt

SEQ ID NO: 351 - DNA, 50 bp, Artificial Sequence
  Description of Artificial Sequence: Synthetic primer
  Category: primer
  Description: Amplify MGA3-8_sgRNA spacer 2
atagacgagcatcatcctctgcatgggttgagaatctttcgaaagaaaga

SEQ ID NO: 352 - DNA, 50 bp, Artificial Sequence
  Description of Artificial Sequence: Synthetic primer
  Category: primer
  Description: Amplify MGA3-8_sgRNA spacer 3
ctcaacgcgttagggtcaatgcgggtcgctatagtgagtcgtattaaggt

SEQ ID NO: 353 - DNA, 50 bp, Artificial Sequence
  Description of Artificial Sequence: Synthetic primer
  Category: primer
  Description: Amplify MGA3-8_sgRNA spacer 3
tatagcgacccgcattgaccctaacgcgttgagaatctttcgaaagaaag

SEQ ID NO: 354 - DNA, 50 bp, Artificial Sequence; identical to SEQ ID NO: 348
  Description of Artificial Sequence: Synthetic primer
  Category: primer
  Description: Amplify MGC3-8_sgRNA spacer 1

SEQ ID NO: 355 - DNA, 50 bp, Artificial Sequence; identical to SEQ ID NO: 349
  Description of Artificial Sequence: Synthetic primer
  Category: primer
  Description: Amplify MGC3-8_sgRNA spacer 1

SEQ ID NO: 356 - DNA, 50 bp, Artificial Sequence; identical to SEQ ID NO: 350
  Description of Artificial Sequence: Synthetic primer
  Category: primer
  Description: Amplify MGC3-8_sgRNA spacer 2

SEQ ID NO: 357 - DNA, 50 bp, Artificial Sequence; identical to SEQ ID NO: 351
  Description of Artificial Sequence: Synthetic primer
  Category: primer
  Description: Amplify MGC3-8_sgRNA spacer 2

SEQ ID NO: 358 - DNA, 50 bp, Artificial Sequence; identical to SEQ ID NO: 352
  Description of Artificial Sequence: Synthetic primer
  Category: primer
  Description: Amplify MGC3-8_sgRNA spacer 3

SEQ ID NO: 359 - DNA, 50 bp, Artificial Sequence; identical to SEQ ID NO: 353
  Description of Artificial Sequence: Synthetic primer
  Category: primer
  Description: Amplify MGC3-8_sgRNA spacer 3

SEQ ID NO: 360 - DNA, 4 bp, Artificial Sequence
  Description of Artificial Sequence: Synthetic oligonucleotide
  Category: PAM
  Description: nMG1-4 (D9A) nickase PAM
  modified_base (1)..(1): a, c, t, g, unknown or other
nrrr

SEQ ID NO: 361 - DNA, 6 bp, Artificial Sequence
  Description of Artificial Sequence: Synthetic oligonucleotide
  Category: PAM
  Description: nMG1-6 (D13A) nickase PAM
  modified_base (1)..(2): a, c, t, g, unknown or other
nnrray

SEQ ID NO: 362 - DNA, 7 bp, Artificial Sequence
  Description of Artificial Sequence: Synthetic oligonucleotide
  Category: PAM
  Description: nMG3-6 (D13A) nickase PAM
  modified_base (1)..(2): a, c, t, g, unknown or other
  modified_base (6)..(6): a, c, t, g, unknown or other
nnrggnt

SEQ ID NO: 363 - DNA, 7 bp, Artificial Sequence
  Description of Artificial Sequence: Synthetic oligonucleotide
  Category: PAM
  Description: nMG3-7 (D12A) nickase PAM
  modified_base (1)..(2): a, c, t, g, unknown or other
  modified_base (4)..(4): a, c, t, g, unknown or other
nnrnyay

SEQ ID NO: 364 - DNA, 7 bp, Artificial Sequence
  Description of Artificial Sequence: Synthetic oligonucleotide
  Category: PAM
  Description: nMG3-8 (D13A) nickase PAM
  modified_base (1)..(2): a, c, t, g, unknown or other
nnrggty

SEQ ID NO: 365 - DNA, 5 bp, Artificial Sequence
  Description of Artificial Sequence: Synthetic oligonucleotide
  Category: PAM
  Description: nMG4-5 (D17A) nickase PAM
  modified_base (1)..(1): a, c, t, g, unknown or other
nrccv

SEQ ID NO: 366 - DNA, 8 bp, Artificial Sequence
  Description of Artificial Sequence: Synthetic oligonucleotide
  Category: PAM
  Description: nMG14-1 (D23A) nickase PAM
  modified_base (1)..(1): a, c, t, g, unknown or other
  modified_base (3)..(4): a, c, t, g, unknown or other
nrnngrka

SEQ ID NO: 367 - DNA, 5 bp, Artificial Sequence
  Description of Artificial Sequence: Synthetic oligonucleotide
  Category: PAM
  Description: nMG15-1 (D8A) nickase PAM
  modified_base (1)..(4): a, c, t, g, unknown or other
nnnnc

SEQ ID NO: 368 - DNA, 6 bp, Artificial Sequence
  Description of Artificial Sequence: Synthetic oligonucleotide
  Category: PAM
  Description: nMG18-1 (D12A) nickase PAM
  modified_base (1)..(1): a, c, t, g, unknown or other
nrwart

SEQ ID NO: 369 - protein, 7 aa, Artificial Sequence
  Description of Artificial Sequence: Synthetic peptide
  Category: NLS
  Description: SV40
PKKKRKV

SEQ ID NO: 370 - protein, 16 aa, Unknown
  Description of Unknown: nucleoplasmin bipartite NLS sequence
  Category: NLS
  Description: nucleoplasmin bipartite NLS
KRPAATKKAGQAKKKK

SEQ ID NO: 371 - protein, 9 aa, Unknown
  Description of Unknown: c-myc NLS sequence
  Category: NLS
  Description: c-myc NLS
PAAKRVKLD

SEQ ID NO: 372 - protein, 11 aa, Unknown
  Description of Unknown: c-myc NLS sequence
  Category: NLS
  Description: c-myc NLS
RQRRNELKRSP

SEQ ID NO: 373 - protein, 38 aa, Homo sapiens
  Category: NLS
  Description: hRNPA1 M9 NLS
NQSSNFGPMKGGNFGGRSSGPYGGGGQYFAKPRNQGGY

SEQ ID NO: 374 - protein, 42 aa, Unknown
  Description of Unknown: Importin-alpha IBB domain sequence
  Category: NLS
  Description: Importin-alpha IBB domain
RMRIZFKNKGKDTAELRRRRVEVSVELRKAKKDEQILKRRNV

SEQ ID NO: 375 - protein, 8 aa, Unknown
  Description of Unknown: Myoma T protein sequence
  Category: NLS
  Description: Myoma T protein
VSRKRPRP

SEQ ID NO: 376 - protein, 8 aa, Unknown
  Description of Unknown: Myoma T protein sequence
  Category: NLS
  Description: Myoma T protein
PPKKARED

SEQ ID NO: 377 - protein, 8 aa, Unknown
  Description of Unknown: p53 sequence
  Category: NLS
  Description: p53
PQPKKKPL

SEQ ID NO: 378 - protein, 12 aa, Mus sp.
  Category: NLS
  Description: mouse c-abl IV
SALIKKKKKMAP

SEQ ID NO: 379 - protein, 5 aa, Influenza virus
  Category: NLS
  Description: influenza virus NS1
DRLRR

SEQ ID NO: 380 - protein, 7 aa, Influenza virus
  Category: NLS
  Description: influenza virus NS1
PKQKKRK

SEQ ID NO: 381 - protein, 10 aa, Hepatitis delta virus
  Category: NLS
  Description: Hepatitis virus delta antigen
RKLKKKIKKL

SEQ ID NO: 382 - protein, 10 aa, Mus sp.
  Category: NLS
  Description: mouse Mx1 protein
REKKKFLKRR

SEQ ID NO: 383 - protein, 20 aa, Homo sapiens
  Category: NLS
  Description: human poly(ADP-ribose) polymerase
KRKGDEVDGVDEVAKKKSKK

SEQ ID NO: 384 - protein, 17 aa, Homo sapiens
  Category: NLS
  Description: steroid hormone receptor (human) glucocorticoid
RKCLQAGMNLEARKTKK

SEQ ID NO: 385 - protein, 170 aa, Unknown
  Description of Unknown: uncultivated organism
  Category: MG68 putative adenosine deaminase (TadA-like)
  Description: MG68-3 deaminase
MNEQTSTDEQFMQQALALADEAERQGEVPVGALLVHQGTVIGRGFNQVITQLDPSAHAEMLAIRDAARYLQNYRILDTTLYVTLEPCPMCAGALVHARVKRLVYGASDPRTGACGSVFNVVADTRLNHQLEVVAGVLGSQCGERLSAFFRQRRAAQKALKKAAQNFQSPS

SEQ ID NO: 386 - protein, 167 aa, Unknown
  Description of Unknown: uncultivated organism
  Category: MG68 putative adenosine deaminase (TadA-like)
  Description: MG68-4 deaminase
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAEDPKTGACGSVMDIARHPALNHQLQVDGGVMAAPCARLLSDFFRWRRAQKKAARDNSSGN

SEQ ID NO: 387 - protein, 173 aa, Unknown
  Description of Unknown: uncultivated organism
  Category: MG68 putative adenosine deaminase (TadA-like)
  Description: MG68-5 deaminase
MSTDFTSAAQQELDIAYMRKAIALAAQAEADGEVPVGAVLVHNNEIIGVGRNRVIGGCDPSLHAEFEAIRQGAQEIGNYRLLETTLYVTLEPCPMCAGLLVHSRIGRLVYGTPDLKTGAAGSLMNLLQHPELNHQIAITSGVLQADCAAQLSGFFSAQRERKKALKKRLKPNL

SEQ ID NO: 388 - protein, 182 aa, Unknown
  Description of Unknown: uncultivated organism
  Category: MG68 putative adenosine deaminase (TadA-like)
  Description: MG68-6 deaminase
MSEIPQVVTEQQTDERWMHYALALADKAEQAGEIPVGAVLVKDNQVIGEGWNMSICRHDPSAHAEMLAIREAAVRVQNYRLLDTTLYVTLEPCAMCAGLLVHSRVKRLVFGAFDAKTGAAGSVTDLVRHPVLNHQLEVTSGVLAEQCADKLSSFFRRRRQEHKAAKALRQAQDPENQGNSES

SEQ ID NO: 389 - protein, 151 aa, Unknown
  Description of Unknown: uncultivated organism
  Category: MG68 putative adenosine deaminase (TadA-like)
  Description: MG68-7 deaminase
MSDEIWIKHALTLADKAYQQGEVPVGAVLVKNNQIIAEGWNQPIAHHDPSAHAEIMALRLAGQAEQNYRLPETTLYVTLEPCVMCAGAMIHARIGRLVFGAYDPKTGAAGSVFDIFSDARHNHQIEVVSGVLSELCGDKLRAFFRERRKKR

SEQ ID NO: 390 - protein, 166 aa, Unknown
  Description of Unknown: uncultivated organism
  Category: MG68 putative adenosine deaminase (TadA-like)
  Description: MG68-8 deaminase
MPQSEQDIYWIRYAMQLAERAEQAGEVPVGAVLVLDNQALGEGWNLSISRHDPCAHAEIMAIRQAGERIGNYRLLGATLYVTLEPCVMCAGAMVHSRIARVVYGASDLKTGAAGSVFDVLSDPRHNHVVEITGGVESEACSQQLSDFFRRRRAEQKAEKQRLKDNQ

SEQ ID NO: 391 - protein, 168 aa, Unknown
  Description of Unknown: uncultivated organism
  Category: MG68 putative adenosine deaminase (TadA-like)
  Description: MG68-9 deaminase
MNVAADEQWMKEALRQAERALLAGEVPVGAVVVSQNNIVGQGFNRNLLDRDPTAHAEIIALREAAANIGNHRLLDCELYATIEPCAMCAGAITHARVRRLVYGAEDLKAGAVHSVMQVVNHPALNHRVEVKGGVLAERCGELLQQFFWARRAEQSGISGANEDQLRRG

SEQ ID NO: 392 - protein, 143 aa, Unknown
  Description of Unknown: uncultivated organism
  Category: MG68 putative adenosine deaminase (TadA-like)
  Description: MG68-10 deaminase
MLLAMEQARAAEEAGEVPVGAVILSPEGEVVARGENRVLRDSDPTAHAEMVALRAAGRVLGNYRLPGCTLYSTLEPCSMCSGAILHARVARLVFAASDPKAGACGSVLEVMNHPRLNHQVELVGGVLALECGQMLTEFFRARR

SEQ ID NO: 393 - protein, 210 aa, Unknown
  Description of Unknown: uncultivated organism
  Category: MG68 putative adenosine deaminase (TadA-like)
  Description: MG68-11 deaminase
MSAEIDLTDKAFMRQALDQAQNAWLLGEVPVGAVIVREGRVIATGYNRPIGDNDPTAHAEIVALRQAASLLGNYRLPGCTLYVTLEPCAMCAMALMHARLDRVVFGAPDPKTGAAGSVINLFDEPRLNHHCALRGGVEAQDCARLLQDFFRERRRQIQALQQKPAIPADRADPDEQHASLHAEGPAPLAGIDVRHLDEPDAAATSNPESP

SEQ ID NO: 394 - protein, 159 aa, Unknown
  Description of Unknown: uncultivated organism
  Category: MG68 putative adenosine deaminase (TadA-like)
  Description: MG68-12 deaminase
MEIKARMRDIMTDDERWMAKALRLAKEGAQAGEVPVGAILVFSGEQLAAAYNSPIRLRDATAHAEILALRLGGERLQNYRLTGCTLYVTLEPCAMCAGALVQARIARLVFGARDSRVGAAGSALDLAREPRFNHQVTVVGGVLASECEQVLREFFRARR

SEQ ID NO: 395 - protein, 205 aa, Unknown
  Description of Unknown: uncultivated organism
  Category: MG68 putative adenosine deaminase (TadA-like)
  Description: MG68-13 deaminase
MPEPFQGGDPADPARAAAEAQDLADRAFMRLALDQAHNAWLLGEVPVGAVIVHEGRVLATGYNRPIGDSDPTAHAEIVALRQAASLLGNYRLPGCTLYVTLEPCAMCAMALLHARIERVVFGASDPKTGAAGSVLDLFAQPLLNHHASLRAGVEAQACGALLQEFFRERRARARAQQQLPAHGGGIDVRHLDAPEPGDESDPFDE

SEQ ID NO: 396 - protein, 159 aa, Unknown
  Description of Unknown: uncultivated organism
  Category: MG68 putative adenosine deaminase (TadA-like)
  Description: MG68-14 deaminase
MGSDQDFMRLALLEAEKAGAIGEVPVGAVIVKDGKVVARGHNQPVSGHDPTAHAEIMALREAGQVLGNYRLPACDLYVTLEPCAMCIGAMIHARIRRVIFGAHDPKTGAAGSVINLFEEKTLNHHATVTGGILASDCAQLLKAFFAMRRKEAKTPSLSG

SEQ ID NO: 397 - protein, 168 aa, Unknown
  Description of Unknown: uncultivated organism
  Category: MG68 putative adenosine deaminase (TadA-like)
  Description: MG68-15 deaminase
MEPMEEHRHFMGLAIEEAARAYELNEVPVGAVLVGSAGEILSRASNAPIRSADPSAHAEMIALRQAARASGNYRLPGSVLYVTLEPCVMCVGAMLHARIATLVFGARDPRTGAAGSVVDLTSVPAFNHYVRVIAGVRAEECSELLRRFFRERRREGKSGYGGEVPKRP

SEQ ID NO: 398 - protein, 153 aa, Unknown
  Description of Unknown: uncultivated organism
  Category: MG68 putative adenosine deaminase (TadA-like)
  Description: MG68-16 deaminase
MADEDIKFMRLALELAKKAEFIDEVPVGALIIKDGEIIGTGMNSCISDHDPTSHAEIKAIRDAANTIKNYRLNGCSIYVTLEPCAMCVGAIQHARIEKIIYGANDPKTGACGSVIDLMSIKEINHHTEAIGGVLQKECGQILKDFFLSKRKKP

SEQ ID NO: 399 - protein, 148 aa, Unknown
  Description of Unknown: uncultivated organism
  Category: MG68 putative adenosine deaminase (TadA-like)
  Description: MG68-17 deaminase
MQRALGRAGDARAQGEVPVGAVVVCAGEVVGEGCNRNISLDDPSAHAEILALRAAGQRLGNYRLPGCTLYVTLEPCAMCVGAAIHSRLDGVVFGATDPKTGALGGAFDLPASHAHNHVLSVRGGLLADECGALLKAFFRDRRKAPRAP

SEQ ID NO: 400 - protein, 191 aa, Unknown
  Description of Unknown: uncultivated organism
  Category: MG68 putative adenosine deaminase (TadA-like)
  Description: MG68-18 deaminase
MQKKVDDFLKIVEPPDAERRTKGKLLQQRAVDEQWMGLALQRGEEAGRQGEVPVGAVVVGKDGFLTAAGNSPIGLADPSAHAEMLAIRAAAKLLGNYRLPEATLYVTLEPCIMCMGALIQARISRLVFGAADPKTGAAISVYAIGTDQRLNHTVAVTGGILAEACAQLLKNFFKKRRGHSPVINSPFLKTP

SEQ ID NO: 401 - protein, 144 aa, Unknown
  Description of Unknown: uncultivated organism
  Category: MG68 putative adenosine deaminase (TadA-like)
  Description: MG68-19 deaminase
MREAYALALIAYEQGEVPVGAVLVGEDDEILGRGWNQVIQRHDPMAHAECVAIQEAAAQLRNYRLNGSTLYVTLEPCCMCAGAMVHARIARLVFGARDVRSGAAGSAYNLLAGDLLNHRVKIDEGILQQECSHLLRNFFKQRRD

SEQ ID NO: 402 - protein, 195 aa, Unknown
  Description of Unknown: uncultivated organism
  Category: MG68 putative adenosine deaminase (TadA-like)
  Description: MG68-20 deaminase
MTSQVSRQQPLSGNNLVHNDLIASVCPPGLVPAQQDEFWMQQALVLARQAEMMGEVPVGAVVVKNQQLIGYGYNQSITLNDPSAHAEVLALRMAGQTLTNYRLPDTTLYVTLEPCAMCATTMVHARVARLVYGAADLKTGAAGSVLNLTNYTAFNHQLSCVSGVLQRDCSYLLSNFFKLRRTQHKAKKVSGTFIR

SEQ ID NO: 403 - protein, 162 aa, Unknown
  Description of Unknown: uncultivated organism
  Category: MG68 putative adenosine deaminase (TadA-like)
  Description: MG68-21 deaminase
MDHERYMRRAIELAQQAESLGEVPVGAVIVHDHQIIGEGFNEVIRRNDPSAHAEAQAIRAAGQHLANYRLVNTTLYVSLEPCAMCAGLIVHARVKTVVFATPDPRTGATGTAIQVLNHPSMNHHVEVVSGVLQEQSATILQNFFRKKRELAKMKKFHEKRVN

SEQ ID NO: 404 - protein, 166 aa, Unknown
  Description of Unknown: uncultivated organism
  Category: MG68 putative adenosine deaminase (TadA-like)
  Description: MG68-22 deaminase
MSDEHFMRLALAQAALAEAEGEIPVGAVVVLNGEVVGSGYNSPIGRHDPTAHAEIRALRAAAATLGNYRLVGCELFVTLEPCLMCAGAIQHARIARLVYGAADYKTGVCGSTLDVFGELPGSPVPRLNHHTQVTGGVLGDECSRQLSAFFARRRAEKNAAKNHVFQ

SEQ ID NO: 405 - protein, 161 aa, Unknown
  Description of Unknown: uncultivated organism
  Category: MG68 putative adenosine deaminase (TadA-like)
  Description: MG68-23 deaminase
MDSLVERHEHYMMLALRLAEKGADRGEVPVGAVVVSPKGQILSLAHNEPIDLHDPTGHAEIIAIRKAAQRIGNYRLVGCSLYVTLEPCVMCYGAIIHARIKRLFFGAYDPKAGAGTVFGLFSSPFFNHQPEVRGGILAELCEKVLKEFFEKLRSSKCCSSG

SEQ ID NO: 406 - protein, 152 aa, Unknown
  Description of Unknown: uncultivated organism
  Category: MG68 putative adenosine deaminase (TadA-like)
  Description: MG68-24 deaminase
MTEDERWMEEALALAREASNDGEAPVGAVVVHAGEIIGRGRNRIEGLADPTAHAELLALRQASMNLGRWRLTGCALFVTLEPCAMCLGACYAARVDRLVYGATSPKFGAAGSSVTLAGVERLNHRLEVVSGVLEKECARLLAKFFRGLRGKG

SEQ ID NO: 407 - protein, 168 aa, Unknown
  Description of Unknown: uncultivated organism
  Category: MG68 putative adenosine deaminase (TadA-like)
  Description: MG68-25 deaminase
MDDQHWMGRALALAERAAEQGEVPGGAVLVIENEIVGEGWSRPIATQDPSAHAEILALRDAGLRRGNYRLSGSVLYVTLEPCVMCAGAIVHARVDTLVFGAADPKAGACGSVFDLLPSDGRFNHHTQCRGPILADACGTILRAFFANKRASPRARANASAAHERPEND

SEQ ID NO: 408 - protein, 173 aa, Unknown
  Description of Unknown: uncultivated organism
  Category: MG68 putative adenosine deaminase (TadA-like)
  Description: MG68-26 deaminase
MSESQFDETQYRWMDRALELAGQAANLGEVPVGAVIVSAEGELLGEGFNQPIKVQDPTAHAEIMAIRQACRKTGNYRLPGAVLYVTLEPCAMCAGAIVHARLARVVFATCEPKAGAVESTLRFFDLPQLNHRVEYTGGLRRSEASSLLSHFFQSRREEKALLKKNSRQQQSDC

SEQ ID NO: 409 - protein, 164 aa, Unknown
  Description of Unknown: uncultivated organism
  Category: MG68 putative adenosine deaminase (TadA-like)
  Description: MG68-27 deaminase
MREEKDLIFMKKALHLAEEAWRQGEVPVGAVVVDGEGQIIGQGYNQSIALLDPTAHAEIVALRQAAKKKKNYRLSGSTLYVTLEPCPMCLGAMVQARIDRLVFGAYDPKNGAVSSIMNFPLDKMNHRFEIEGGLLSQECATILKEFFQSRRGETNNKKETAKEE

SEQ ID NO: 410 - protein, 153 aa, Unknown
  Description of Unknown: uncultivated organism
  Category: MG68 putative adenosine deaminase (TadA-like)
  Description: MG68-28 deaminase
MDTDEQFMQHAIQLAHKAQSQGEVPVGAILVKDNKIIGKGWNQPITRHDPSAHAEIMAIRHAGQALKNYRLPDTTLYVTLEPCNMCAGMIIHARIKRLVFAAYDPKTGAAGSVFDTLTDPRNNHTVEIEGGVLEEPCAEMLRHFFRQRRKKTP

SEQ ID NO: 411 - protein, 158 aa, Unknown
  Description of Unknown: uncultivated organism
  Category: MG68 putative adenosine deaminase (TadA-like)
  Description: MG68-29 deaminase
MSELENNNPQHIKWMREAIKLAQKAQECGEVPVGALITKNDTLISSAYNQPITKHDPTAHAEIQALQQAGKILQNYRLNDTVLYITLEPCAMCAGAIVHARIGTVVFGAYDHKTGVAGSAGNIFTAEFSNHKPKIIGGTLEKECSLIIRNFFQARRQK

SEQ ID NO: 412 - protein, 182 aa, Unknown
  Description of Unknown: uncultivated organism
  Category: MG68 putative adenosine deaminase (TadA-like)
  Description: MG68-30 deaminase
MPNFLKQLQQIIAFETSCAADWSEQQKHVFWMQQALKVAAYGEQLGEVPVGAVAVVENQLIAVGWNASISKHDPTAHAEVMALRAAGTVLKNYRQLQLTLYVTLEPCAMCAGAMVHARIAQLVYGASDPKTGAVDSVFNLLRHPNLNHQAPVLGGVLATECRTQLQDFFRRRRQEKKQAQQK

SEQ ID NO: 413 - protein, 167 aa, Unknown
  Description of Unknown: uncultivated organism
  Category: MG68 putative adenosine deaminase (TadA-like)
  Description: MG68-31 deaminase
MESVDEQWMRYAIRLAQRAEEQGEVPVGAVLVKGDRCLAEGWNVPVQRHDPTAHAEMVAIRDAGIALENYRLIDSTLYVTLEPCVMCMGAIAHARIKRLVFGAFDPKRGAVCNALSLTDASFLNHKVVWDGGVFEQECSELLIDFFKARRKVTKPEVVVTNPQRHGM

SEQ ID NO: 414 - protein, 160 aa, Unknown
  Description of Unknown: uncultivated organism
  Category: MG68 putative adenosine deaminase (TadA-like)
  Description: MG68-32 deaminase
MYNQQAIDKHFMNCALELATFAADSGEVPVGAVIVRKNTIVAKGSNSPIADHDPTAHAEIIAIRKATAQCANYRTPDTTLYVTLEPCIMCMGAIIQARIGRLVFGAYDAKTGAAGSCYSIGQDNLLNHSLEIAGGINEQQCAILLKKFFKIRRKKGSKNN

SEQ ID NO: 415 - protein, 150 aa, Unknown
  Description of Unknown: uncultivated organism
  Category: MG68 putative adenosine deaminase (TadA-like)
  Description: MG68-33 deaminase
MSDLEWMRRAITLAQKAEQQGEVPVGALLVREGVCVGEGWNQPILRHDPSAHAEINALRDAGQATENYRLIDTVLYVTLEPCVMCMGAIANARVRRLVFGASDPARGAAGSILSLSNASFLNHHIETEGGLLAEECSELLRSFFARRRRK

SEQ ID NO: 416 - protein, 155 aa, Unknown
  Description of Unknown: uncultivated organism
  Category: MG68 putative adenosine deaminase (TadA-like)
  Description: MG68-34 deaminase
MSPVVAESDRAWMRHALELANRAGEEGEVPVGAVMVKDGQLVGEGWNRVIGLNDPSAHAEILALREAGQRLGNYRLPGCSLYVTLEPCAMCAGAMLHARLERVYFGTGDPKTGALGGTFDLFADYPHNHRIETQGGLLEIECSSLLKEFFRARRL

SEQ ID NO: 417 - protein, 194 aa, Unknown
  Description of Unknown: uncultivated organism
  Category: MG68 putative adenosine deaminase (TadA-like)
  Description: MG68-35 deaminase
MGLNGLTHHSPFIPISENIDTSDKLALQIMSLKLSNPDEKWMRHAQSLAEHAAAQGEIPVGAVIVQAGECIAEGWNQPIANNDPTAHAEIIALRKAAQYLNNYRLVNTLLYVTLEPCVMCAGAIIQARVKRVIFGAYDPKAGAAGSRFDILRDTRHNYQVECISGVLAKECSDYLSRFFKNRRTRAKPSRFPKP

SEQ ID NO: 418 - protein, 174 aa, Unknown
  Description of Unknown: uncultivated organism
  Category: MG68 putative adenosine deaminase (TadA-like)
  Description: MG68-36 deaminase
MQDDTVPEEIDHERWMRQALNEAMDAAEEGEVPVGAVVVYENRIIGRGHNRTVATHDPSAHAEILALGAAGAAVGDWRLTGVDIYVSLEPCAMCAGAIQLGRLRRAVFGPRDPKFGGCGSVLDVLREPRLNHQVEVIEGVMAAESQHLLKEFFRRLRAKDRVPATPDPFPNAGE

SEQ ID NO: 419 - protein, 149 aa, Unknown
  Description of Unknown: uncultivated organism
  Category: MG68 putative adenosine deaminase (TadA-like)
  Description: MG68-37 deaminase
MEEEYFMREALKEAEKAAQEGEVPIGAVVVGPSREIIGRGYNRPIGLCDPTAHAEIMALREAAKRLGNYRLLDCEIYVTLEPCPMCAGALVYARLKRLVFGAHDPKAGACGSVYNIVQDKRLNHQLEVAGGLLAEECRALLQAFFKSRR

SEQ ID NO: 420 - protein, 160 aa, Unknown
  Description of Unknown: uncultivated organism
  Category: MG68 putative adenosine deaminase (TadA-like)
  Description: MG68-38 deaminase
MFEFSDNKAEFFMKQAILQAIRAWKKGEVPVGAVVVSGAGQILASAHNCPISLDDPTAHAEILALRLAAGKVGNYRLTDSWLISTLEPCVMCAGAMVWARVKGVVFGARDPVSGAFGSVMDINEVPGLNHRIEVTEGVLAAECSQLLKDFFKRRRQSSAG

SEQ ID NO: 421 - protein, 148 aa, Unknown
  Description of Unknown: uncultivated organism
  Category: MG68 putative adenosine deaminase (TadA-like)
  Description: MG68-39 deaminase
MTDENWMQRALQLAAQAEAVGEVPVGAVIVKNDTLVAEGFNQPIGAHDATAHAEIVALRRAGEALGNYRLVDTTLYVTLEPCSMCVGAMIHARVAKVVFGASDPRTGALGGAFDLQQAGRHNHRFDVVSGVMADSSRQLLQNFFRVRR

SEQ ID NO: 422 - protein, 149 aa, Unknown
  Description of Unknown: uncultivated organism
  Category: MG68 putative adenosine deaminase (TadA-like)
  Description: MG68-40 deaminase
MTEDEKWMNLAIEQAIKAQDEDEVPVGAVLVKNGLLLSQAHNQPISTNDATAHAEIQALRKAGIKLQNYRLTDSTLYVTLEPCAMCLGAMMHARIARIVYGANDLKTGACGSSENLLNANCFNHKIHLISGVLENECKQLLKKFFNSRR

SEQ ID NO: 423 - protein, 185 aa, Unknown
  Description of Unknown: uncultivated organism
  Category: MG68 putative adenosine deaminase (TadA-like)
  Description: MG68-41 deaminase
MNQVNCGRIGSRLIRTGGVNISRAPIEEDPVNDLQYAQDTKWMRCALDCARRAYSTEEVPIGAVLVRNEQIIGEGFNQTIRNLDPTSHAEIMAIRSAAENIGNYRLSDTTLYVTIEPCMMCLGAIIHARVERLVFGAQEPKAGVLKSHPVFDGDFLNHQVKWSSGILESECSRLMRDFFIHKRTL

SEQ ID NO: 424 - protein, 203 aa, Unknown
  Description of Unknown: uncultivated organism
  Category: MG68 putative adenosine deaminase (TadA-like)
  Description: MG68-42 deaminase
MAPVPLKQPLAGESFDAHDHAMMRLAIDQALNAQLHGEVPVGAVLVKGGQVIATGYNHPIGSHDPTAHAEIRTLRMAAEQLGNYRLGESTLYVTLEPCMMCLGAMLHARITRVVFGASDPKTGVCGGVLDLPAEGRLNHQTTVQGGLLAEECGELLQRFFAERRAQRRADREALRAQQDELLRWAATLPAEEEVGTLRLDEET

SEQ ID NO: 425 - protein, 150 aa, Unknown
  Description of Unknown: uncultivated organism
  Category: MG68 putative adenosine deaminase (TadA-like)
  Description: MG68-43 deaminase
MAMALAEAEKAMQIGEVPIGAVVVGPDQQLLGTGYNQSICLNDPSAHAEMLAIRAAAAQLGNYRLRDCTLYVTLEPCAMCMGAILHSRIQRVVFAAADPKTGACGSVLSLQSEPRLNHHCSVTQGVLAERAASLIKGFFKARRQVKKCRC

SEQ ID NO: 426 - protein, 164 aa, Unknown
  Description of Unknown: uncultivated organism
  Category: MG68 putative adenosine deaminase (TadA-like)
  Description: MG68-44 deaminase
MLHMVYYEINETNSQDVFFMRRALTLAQKAASADEVPVGAVAIANNEIIGEGFNCPIGTHDPTAHAEIMALRQAAQKSNNYRLPEVTLYVTLEPCVMCVGAMLHARIKRLVFGAIDQKTGAVVSVFKILDEKNLNHRIQYQSGVLAVPCGKILSDFFKDRRGVI

SEQ ID NO: 427 - protein, 180 aa, Unknown
  Description of Unknown: uncultivated organism
  Category: MG68 putative adenosine deaminase (TadA-like)
  Description: MG68-45 deaminase
MTALITTSNIHDKMMSLALKEAFKAYKLGEIPVGCVITDENNELVATGFNRTIIDNDPSAHAEIVALRKAGEKLQNYRLVNLNLYVTLEPCTMCSGAIIHARIKRVFFGAYDLKTGACGSVFNVLNDDRHNHKVEIYGGILKEECSSMLSDFFKARRKMQKEGRDWIVESGKDRTWLNKD

SEQ ID NO: 428 - protein, 153 aa, Unknown
  Description of Unknown: uncultivated organism
  Category: MG68 putative adenosine deaminase (TadA-like)
  Description: MG68-46 deaminase
MISDTEFMGAALELALAASKLGEVPVGAVVVKGGRIIGTGSNAPISRHDPTAHAEILALRAAASALENYRLTECTLYVTLEPCAMCAGAIQHARIARLVFGASDSKTGACGSVVNLFGEPMLNHHTQVQGGMLARDCGELLSDFFRQRRAAVQ

SEQ ID NO: 429 - protein, 160 aa, Unknown
  Description of Unknown: uncultivated organism
  Category: MG68 putative adenosine deaminase (TadA-like)
  Description: MG68-47 deaminase
MSGSDAAASRACMEQALACARDAEAAGEVPVGAVIVDAAGAVVARAANAPIARNDPTAHAELLVLRAAGRVLGNYRLPGCVLYVTLEPCAMCVGALVHARIARIVYGAPDPKTGACGSVFDLAANSKMNHRIEVAGGVLAEECGALLKQFFAARRGRDAP

SEQ ID NO: 430 - protein, 151 aa, Unknown
  Description of Unknown: uncultivated organism
  Category: MG68 putative adenosine deaminase (TadA-like)
  Description: MG68-48 deaminase
MFSRADQVFMRQALELAKQAKGEGEVPVGAVLTLNDLPIATAYNQSITHQDPTAHAEIIVLREAAKILKNYRLVNTVLYVTLEPCAMCAGALIHARVKRLIYATADPRTGACGSIFNLINHQALNHQIQYESGLLAEESKLLLQQFFQKRR

SEQ ID NO: 431 - protein, 148 aa, Unknown
  Description of Unknown: uncultivated organism
  Category: MG68 putative adenosine deaminase (TadA-like)
  Description: MG68-49 deaminase
MNDEHYIQYALNLAQKAESENEVPVGALIVCNNQIIAEGWNQPIQLHDSSAHAEMLALRKASHHIENYRLKNTTLYVTLEPCAMCVGAMIHARIQKLVFGAWDQKAGAVHSVFQLIDDTRHNHAIEWRGGVMADACSRVLKNFFKQRR

SEQ ID NO: 432 - protein, 153 aa, Unknown
  Description of Unknown: uncultivated organism
  Category: MG68 putative adenosine deaminase (TadA-like)
  Description: MG68-50 deaminase
MTSHDDTYWIIHALTLAKKAEQQGEVPVGAVIVHDHQIVGEGWNQPIGAGDPTAHAEIIAMRNAAQHLKNYRLINCTLYVTLEPCAMCVGAMVHARISRLVFGAFDPKAGAVTSVMQLLDAPHFNHIVTHQGGICAEKCSEILKSFFAMKRKT

SEQ ID NO: 433 - protein, 155 aa, Unknown
  Description of Unknown: uncultivated organism
  Category: MG68 putative adenosine deaminase (TadA-like)
  Description: MG68-51 deaminase
MTDDRDLYWMQQALLLAVDAGRRGEVPVGALLVLDEVSIGVGYNRPIGDRDPTAHAEIIALRDAAKKINNYRLLDTTLYVTLEPCMMCAAAMVHARIKRLVYGAPDPKAGAIVSQAQILDAPFFNHRVAYYGNLLAMPCGELLRTFFKAKRLSST

SEQ ID NO: 434 - protein, 153 aa, Unknown
  Description of Unknown: uncultivated organism
  Category: MG68 putative adenosine deaminase (TadA-like)
  Description: MG68-52 deaminase
MRLAMDMAKEAYSIGEVPVGCVIADADGNVISTGYNRSITDNDPSAHAEMVAIRNAGSLLKNYRMPGLSLYVTLEPCCMCSGAIIHARIARVYYGASDLKTGACGSVFNVMSDPRHNHSVECIGGILADECSKMLSDFFKERRQQKKAEATKL

SEQ ID NO: 435 - protein, 174 aa, Unknown
  Description of Unknown: uncultivated organism
  Category: MG68 putative adenosine deaminase (TadA-like)
  Description: MG68-53 deaminase
MTVNHEYFMRLAIEQALLAYQAGEIPVGAVIVDTDGNVIGRGFNRTILDNDPSAHAEIVALRDAGERVKNYRLINLDMYVTLEPCTMCSGALIHSRLNNLYFGAYDLKTGACGSRFNILGSSEYNHIVNVTGGILKEECQNIISDFFKARRKMQKDGRDWIVESGKVRSWQKNV

SEQ ID NO: 436 - protein, 172 aa, Unknown
  Description of Unknown: uncultivated organism
  Category: MG68 putative adenosine deaminase (TadA-like)
  Description: MG68-54 deaminase
MTSPTAGLGETDEYWMNRALALAAEAGESGEVPVGAVVVLDGREVGAGYNGPIGSCDPTAHAEIRALRDAGARAGNYRLPGATLYVTLEPCTMCVGAIVHARINRLVYGTTEPKAGAVESIRQTLRDDHFNWQVEATGGVLASQCREIIQRFFAGRREYHRLRKQTLSVKEQ

SEQ ID NO: 437 - protein, 158 aa, Unknown
  Description of Unknown: uncultivated organism
  Category: MG68 putative adenosine deaminase (TadA-like)
  Description: MG68-55 deaminase
MPDLDDGYWMQQALKLAAQAKDQGEVPVGALVVGEQKLLGQGYNQVISLQDPSAHAEVMALRGAGITQQNYRLVNTTLYVTLEPCMMCAGVLVHARIKRLVFGAYDPKAGAISSCAQLLTLPHLNHQILVQGGILAKECGQQLTDFFKAKRQAKHDKG

SEQ ID NO: 438 - protein, 157 aa, Unknown
  Description of Unknown: uncultivated organism
  Category: MG68 putative adenosine deaminase (TadA-like)
  Description: MG68-56 deaminase
MTAAAEFDEHDLRWMRQALELARRAERDHAEVPVGAVLVIDNEVIGSGMNRNIIDHDASAHAEIVCLRDAGQRVANHRFPGSTLYVTLEPCVMCAGAIVHARVGRVVYAASDPKTGAAGSVFDILTSERHNHRVAVRGGLLAEESARLLQLFFRSRR

SEQ ID NO: 439 - protein, 176 aa, Unknown
  Description of Unknown: uncultivated organism
  Category: MG68 putative adenosine deaminase (TadA-like)
  Description: MG68-57 deaminase
MSESSAVYSDEYWLRYALQLAERAYQQGEVPVGAVLVRDNQILGEGWNQSISQHDATAHAEIMALRAAGLVAGNYRLPNTSLYVTLEPCVMCAGALLHARVERVVFGAYDPKTGAVGSMFDVLLDARHNHQVQLTGGVLQADCVAQLQAFFKERRLAQKLAKFNSVTISSPTSTEN

SEQ ID NO: 440 - protein, 158 aa, Unknown
  Description of Unknown: uncultivated organism
  Category: MG68 putative adenosine deaminase (TadA-like)
  Description: MG68-58 deaminase
MSLADRHEMFMQMALQQAQLAYDCAEVPVGAVVVNSAGEVIGKGYNRTIIDSDPTAHAEIVALRQAAAHEQNYRLPDLTVYVTLEPCVMCIGALTHARIAHVVYGASDPKTGACGSVLCIQANKKINHHTRITSGVLEQACAEKLRHFFRERRKGSKL

SEQ ID NO: 441 - protein, 154 aa, Unknown
  Description of Unknown: uncultivated organism
  Category: MG68 putative adenosine deaminase (TadA-like)
  Description: MG68-59 deaminase
MADDDFMALAIEQALLAQAQGEVPVGAVLVDGSGHVIGRGANAVIGLSDPTAHAEIVALRSAAKLLGNYRLPQTTLFVTLEPCAMCLGALFHARVSRIVFGAPDPKTGACGSRLDLTAPDLINFHASVRGGVMQEACGHLLTDFFKRKRSEKLS

SEQ ID NO: 442 - protein, 204 aa, Unknown
  Description of Unknown: uncultivated organism
  Category: MG68 putative adenosine deaminase (TadA-like)
  Description: MG68-60 deaminase
MRVALGAAREAQAAGEVPVGAVIVRDGVLIATGRNAPRQQHDPTAHAEIAALRAAARRLGNYRLDGCTLYVTLEPCLMCVGAMLHARLERVVFGAPDPKTGAAGSVFNALAEPKLNHQTTVEGGVLATECAALLQVFFGQRRLLQRISAQPLRDDALRTSEARMAAFASPLSRWVCDLPALQGLRLHYLDMGPSTEGRAWLLLH

SEQ ID NO: 443 - protein, 168 aa, Unknown
  Description of Unknown: uncultivated organism
  Category: MG68 putative adenosine deaminase (TadA-like)
  Description: MG68-61 deaminase
MNTEQSKPLLGDAHFMQQALQLADAAFALQEVPVGAVVVQDGIIIGRGFNAPITQHDPCAHAEILALRDAAKNIGNYRLVGCELFVTLEPCVMCAGAMMHARIARVVYGAYDLKTGACGSVQNVFNEPRWNHHTICTGGVLAEQCGTKLSQFFALRRAQKKSLTATWT

SEQ ID NO: 444 - protein, 283 aa, Unknown
  Description of Unknown: uncultivated organism
  Category: MG121 deaminase
  Description: MG121-1 deaminase
MKVTLGGQTIDVEEVLKRISSTTVAAALIKDGEVVAVEETGGEHAEKKLVRKHDVEGAVIFVTARPCRYCAEAMAEAGVAGVVYLGKGRGYGPYLLERLGVPCVEVHPSEPPAWRPVPRLDVLITFGGNPYLTEEDVAARTYALLTGIGVEAEVVPAPNNMAGRVEVMVKRGDPDRAHGRLKETFGPVFKVRRFQLSGDYEDRESLAEDVLEVVEPLIEDPFAVRANVASPGPTFSGSKEAEVFIGDVLTSAGHEVDLEDPRTLVHVDVLGRRVSVGVERRDG

SEQ ID NO: 445 - protein, 279 aa, Unknown
  Description of Unknown: uncultivated organism
  Category: MG121 deaminase
  Description: MG121-2 deaminase
VKITLAGETIDVEKVLREIPTRTVTAALIKDGEVKAYEEADGEHAEKKLIRNHDVSDGVVFVTIRPCLYCARELAKAGVAGVVYIGRGRGLGPYYLARKGIEVVEVNPSRPLHYDPVERLDVLVTFGGNPYLTEEDVAARVYCLLTGKGIKAEIAPAPENLAGRVEVMITDGDSERAARVIERELPTFNVRHFLLSDRFDDREELSKRVLEEIEPRVEDPFAVRARIARAGLFSSSRDAEVFLGDVLTSAGHEVDLDEPRTVVHVDVLGDRVSVGVEKR

SEQ ID NO: 446 - protein, 283 aa, Unknown
  Description of Unknown: uncultivated organism
  Category: MG121 deaminase
  Description: MG121-3 deaminase
MKVTLGGQTIDVEEVLKRISSTTVAAALIKDGEVVAVEETGGEHAEKKLVRKHDVEGAVIFVTARPCRYCAEAMAEAGVAGVVYLGKGRGYGPYLLERLGVPCVEVHPSEPPAWRPVPRLDVLITFGGNPYLTEEDVAARTYALLTGIGIEAEVVPAPNNMAGRVEVMVKRGDPDRAHGRLKETFGSVFKVRRFQLSGDYEDRESLAEDVLEVVEPLIEDPFAVRANVASPGPTFSGSKEAEVFIGDVLTSAGHEVDLEDPRTLVHVDVLGRRVSVGVERRDG

SEQ ID NO: 447 - protein, 280 aa, Unknown
  Description of Unknown: uncultivated organism
  Category: MG121 deaminase
  Description: MG121-4 deaminase
MRSAEYLAYLRRRYGLRPNRRLGQHFMVDDRLLRFMVEAAGVGPEDTVLEIGPGPGLLTRYLIERAGRVVAVELDERLVEVLERELGDAENLEIVHADFLEYGVPEEVNKVVSNLPYQISSEATFEILRSDVERAVLTYQREFAERMTAEPGTRGYGRLTVMVNLLARVEVLRAVPRRAFVPPPRVSSAIVRLEPRPESELPDVDPETLEAVCRGLFQHRRKTVRNALRLSAHEWGGDEEVVEEVLRRLPEELLDKRPLHLTPEEVVRVARCVERARGSS

SEQ ID NO: 448 - protein, 167 aa, Artificial Sequence
  Description of Artificial Sequence: Synthetic polypeptide
  Category: MG68 putative adenosine deaminase (TadA-like)
  Description: MG68-4_V1
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGN

SEQ ID NO: 449 - protein, 167 aa, Artificial Sequence
  Description of Artificial Sequence: Synthetic polypeptide
  Category: MG68 putative adenosine deaminase (TadA-like)
  Description: MG68-4_V2
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGVENPKTGACGSVMDIARHPALNHQLQVDGGVMAAPCARLLSDFFRWRRAQKKAARDNSSGN

SEQ ID NO: 450 - protein, 167 aa, Artificial Sequence
  Description of Artificial Sequence: Synthetic polypeptide
  Category: MG68 putative adenosine deaminase (TadA-like)
  Description: MG68-4_V3
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSYFFRWRRAQKKAARDNSSGN

SEQ ID NO: 451 - protein, 167 aa, Artificial Sequence
  Description of Artificial Sequence: Synthetic polypeptide
  Category: MG68 putative adenosine deaminase (TadA-like)
  Description: MG68-4_V4
MTDSQNDTDEYWMGEALKLAQKAWDEGEVPVGAILVRKGEVIGHGWNRSIGSHDPSAHAEIMAIREAGVRIGNYRMLDTVLYVTFEPCAMCAGALVHGRISRLVFGAENPKTGACGSVMDIARHPALNHQLQVDGGVMAAPCARLLSDFFRWRRAQKKAARDNSSGN

SEQ ID NO: 452 - protein, 167 aa, Artificial Sequence
  Description of Artificial Sequence: Synthetic polypeptide
  Category: MG68 putative adenosine deaminase (TadA-like)
  Description: MG68-4_V5
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARYPALNHQLQVDGGVMAAPCARLLSDFFRWRRAQKKAARDNSSGN

SEQ ID NO: 453 - protein, 167 aa, Artificial Sequence
  Description of Artificial Sequence: Synthetic polypeptide
  Category: MG68 putative adenosine deaminase (TadA-like)
  Description: MG68-4_V6
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCNRLLSDFFRWRRAQKKAARDNSSGN

SEQ ID NO: 454 - protein, 167 aa, Artificial Sequence
  Description of Artificial Sequence: Synthetic polypeptide
  Category: MG68 putative adenosine deaminase (TadA-like)
  Description: MG68-4_V7
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLCDFFRWRRAQKKAARDNSSGN

SEQ ID NO: 455 - protein, 167 aa, Artificial Sequence
  Description of Artificial Sequence: Synthetic polypeptide
  Category: MG68 putative adenosine deaminase (TadA-like)
  Description: MG68-4_V8
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKNAARDNSSGN

SEQ ID NO: 456 - protein, 167 aa, Artificial Sequence
  Description of Artificial Sequence: Synthetic polypeptide
  Category: MG68 putative adenosine deaminase (TadA-like)
  Description: MG68-4_V9
MTDSQNDTDEYWMGEALKLAQKARDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGN

SEQ ID NO: 457 - protein, 167 aa, Artificial Sequence
  Description of Artificial Sequence: Synthetic polypeptide
  Category: MG68 putative adenosine deaminase (TadA-like)
  Description: MG68-4_V10
MTDSQNDTDEYWMGEALKLAQKAWDEGEVPVGAILVRKGEVIGHGWNRSIGSHDPSAHAEIMAIREAGVRIGNYRMLDTVLYSTLEPCAMCAGALVHGRISRLVFGAENPKTGACGSVMDIARHPALNHQLQVDGGVMAAPCARLLSDFFRWRRAQKKAARDNSSGN

SEQ ID NO: 458 - protein, 167 aa, Artificial Sequence
  Description of Artificial Sequence: Synthetic polypeptide
  Category: MG68 putative adenosine deaminase (TadA-like)
  Description: MG68-4_V11
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKRGACGSVMDIARHPALNHQLQVDGGVMAAPCARLLSDFFRWRRAQKKAARDNSSGN

SEQ ID NO: 459 - protein, 167 aa, Artificial Sequence
  Description of Artificial Sequence: Synthetic polypeptide
  Category: MG68 putative adenosine deaminase (TadA-like)
  Description: MG68-4_V12
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSRFFRWRRAQKKAARDNSSGN

SEQ ID NO: 460 - protein, 167 aa, Artificial Sequence
  Description of Artificial Sequence: Synthetic polypeptide
  Category: MG68 putative adenosine deaminase (TadA-like)
  Description: MG68-4_V13
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRPAQKKAARDNSSGN

SEQ ID NO: 461 - protein, 167 aa, Artificial Sequence
  Description of Artificial Sequence: Synthetic polypeptide
  Category: MG68 putative adenosine deaminase (TadA-like)
  Description: MG68-4_V14
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGVENPKTGACGSVMDIARHPALNHQLQVDGGVMAAPCARLLSYFFRWRRAQKKAARDNSSGN

SEQ ID NO: 462 - protein, 167 aa, Artificial Sequence
  Description of Artificial Sequence: Synthetic polypeptide
  Category: MG68 putative adenosine deaminase (TadA-like)
  Description: MG68-4_V15
MTDSQNDTDEYWMGEALKLAQKAWDEGEVPVGAILVRKGEVIGHGWNRSIGSHDPSAHAEIMAIREAGVRIGNYRMLDTVLYVTFEPCAMCAGALVHGRISRLVFGVENPKTGACGSVMDIARHPALNHQLQVDGGVMAAPCARLLSYFFRWRRAQKKAARDNSSGN

SEQ ID NO: 463 - protein, 167 aa, Artificial Sequence
  Description of Artificial Sequence: Synthetic polypeptide
  Category: MG68 putative adenosine deaminase (TadA-like)
  Description: MG68-4_V16
MTDSQNDTDEYWMGEALKLAQKAWDEGEVPVGAILVRKGEVIGHGWNRSIGSHDPSAHAEIMAIREAGVRIGNYRMLDTVLYVTFEPCAMCAGALVHGRISRLVFGVENPKTGACGSVMDIARYPALNHQLQVDGGVMAAPCARLLSDFFRWRRAQKKAARDNSSGN

SEQ ID NO: 464 - protein, 167 aa, Artificial Sequence
  Description of Artificial Sequence: Synthetic polypeptide
  Category: MG68 putative adenosine deaminase (TadA-like)
  Description: MG68-4_V17
MTDSQNDTDEYWMGEALKLAQKAWDEGEVPVGAILVRKGEVIGHGWNRSIGSHDPSAHAEIMAIREAGVRIGNYRMLDTVLYVTFEPCAMCAGALVHGRISRLVFGVENPKTGACGSVMDIARYPALNHQLQVDGGVMAAPCNRLLSYFFRWRRAQKKAARDNSSGN

SEQ ID NO: 465 - protein, 167 aa, Artificial Sequence
  Description of Artificial Sequence: Synthetic polypeptide
  Category: MG68 putative adenosine deaminase (TadA-like)
  Description: MG68-4_V18
MTDSQNDTDEYWMGEALKLAQKAWDEGEVPVGAILVRKGEVIGHGWNRSIGSHDPSAHAEIMAIREAGVRIGNYRMLDTVLYVTFEPCAMCAGALVHGRISRLVFGVENPKTGACGSVMDIARYPALNHQLQVDGGVMAAPCARLLCYFFRWRRAQKKAARDNSSGN

SEQ ID NO: 466 - protein, 167 aa, Artificial Sequence
  Description of Artificial Sequence: Synthetic polypeptide
  Category: MG68 putative adenosine deaminase (TadA-like)
  Description: MG68-4_V19
MTDSQNDTDEYWMGEALKLAQKAWDEGEVPVGAILVRKGEVIGHGWNRSIGSHDPSAHAEIMAIREAGVRIGNYRMLDTVLYVTFEPCAMCAGALVHGRISRLVFGVENPKTGACGSVMDIARYPALNHQLQVDGGVMAAPCARLLSYFFRWRRAQKNAARDNSSGN

SEQ ID NO: 467 - protein, 167 aa, Artificial Sequence
  Description of Artificial Sequence: Synthetic polypeptide
  Category: MG68 putative adenosine deaminase (TadA-like)
  Description: MG68-4_V20
MTDSQNDTDEYWMGEALKLAQKAWDEGEVPVGAILVRKGEVIGHGWNRSIGSHDPSAHAEIMAIREAGVRIGNYRMLDTVLYVTFEPCAMCAGALVHGRISRLVFGVENPKTGACGSVMDIARYPALNHQLQVDGGVMAAPCARLLCYFFRWRRAQKNAARDNSSGN

SEQ ID NO: 468 - protein, 167 aa, Artificial Sequence
  Description of Artificial Sequence: Synthetic polypeptide
  Category: MG68 putative adenosine deaminase (TadA-like)
  Description: MG68-4_V21
MTDSQNDTDEYWMGEALKLAQKARDEGEVPVGAILVRKGEVIGHGWNRSIGSHDPSAHAEIMAIREAGVRIGNYRMLDTVLYVTFEPCAMCAGALVHGRISRLVFGVENPKTGACGSVMDIARYPALNHQLQVDGGVMAAPCARLLCYFFRWRRAQKNAARDNSSGN

SEQ ID NO: 469 - protein, 167 aa, Artificial Sequence
  Description of Artificial Sequence: Synthetic polypeptide
  Category: MG68 putative adenosine deaminase (TadA-like)
  Description: MG68-4_V22
MTDSQNDTDEYWMGEALKLAQKARDEGEVPVGAILVRKGEVIGHGWNRSIGSHDPSAHAEIMAIREAGVRIGNYRMLDTVLYVTFEPCAMCAGALVHGRISRLVFGVENPKTGACGSVMDIARYPALNHQLQVDGGVMAAPCNRLLCYFFRWRRAQKNAARDNSSGN

SEQ ID NO: 470 - protein, 167 aa, Artificial Sequence
  Description of Artificial Sequence: Synthetic polypeptide
  Category: MG68 putative adenosine deaminase (TadA-like)
  Description: MG68-4_V23
MTDSQNDTDEYWMGEALKLAQKARDEGEVPVGAILVRKGEVIGHGWNRSIGSHDPSAHAEIMAIREAGVRIGNYRMLDTVLYVTFEPCAMCAGALVHGRISRLVFGVENPKTGACGSVMDIARYPALNHQLQVDGGVMAAPCNRLLCYFFRWRPAQKNAARDNSSGN

SEQ ID NO: 471 - protein, 167 aa, Artificial Sequence
  Description of Artificial Sequence: Synthetic polypeptide
  Category: MG68 putative adenosine deaminase (TadA-like)
  Description: MG68-4_V24
MTDSQNDTDEYWMGEALKLAQKARDEGEVPVGAILVRKGEVIGHGWNRSIGSHDPSAHAEIMAIREAGVRIGNYRMLDTVLYSTFEPCAMCAGALVHGRISRLVFGVENPKTGACGSVMDIARYPALNHQLQVDGGVMAAPCNRLLCYFFRWRPAQKNAARDNSSGN

SEQ ID NO: 472 - protein, 167 aa, Artificial Sequence
  Description of Artificial Sequence: Synthetic polypeptide
  Category: MG68 putative adenosine deaminase (TadA-like)
  Description: MG68-4_V25
MTDSQNDTDEYWMGEALKLAQKARDEGEVPVGAILVRKGEVIGHGWNRSIGSHDPSAHAEIMAIREAGVRIGNYRMLDTVLYSTFEPCAMCAGALVHGRISRLVFGVENPKTGACGSVMDIARHPALNHQLQVDGGVMAAPCNRLLCYFFRWRPAQKNAARDNSSGN

SEQ ID NO: 473 - protein, 167 aa, Artificial Sequence
  Description of Artificial Sequence: Synthetic polypeptide
  Category: MG68 putative adenosine deaminase (TadA-like)
  Description: MG68-4_V26
MTDSQNDTDEYWMGEALKLAQKARDEGEVPVGAILVRKGEVIGHGWNRSIGSHDPSAHAEIMAIREAGVRIGNYRMLDTVLYSTFEPCAMCAGALVHGRISRLVFGVENPKTGACGSVMDIARHPALNHQLQVDGGVMAAPCNRLLCRFFRWRPAQKNAARDNSSGN

SEQ ID NO: 474 - protein, 167 aa, Artificial Sequence
  Description of Artificial Sequence: Synthetic polypeptide
  Category: MG68 putative adenosine deaminase (TadA-like)
  Description: MG68-4_V27
MTDSQNDTDEYWMGEALKLAQKARDEGEVPVGAILVRKGEVIGHGWNRSIGSHDPSAHAEIMAIREAGVRIGNYRMLDTVLYSTFEPCAMCAGALVHGRISRLVFGVENPKRGACGSVMDIARHPALNHQLQVDGGVMAAPCNRLLCRFFRWRPAQKNAARDNSSGN

SEQ ID NO: 475 - protein, 167 aa, Artificial Sequence
  Description of Artificial Sequence: Synthetic polypeptide
  Category: MG68 putative adenosine deaminase (TadA-like)
  Description: MG68-4_V28
MTDSQNDTDEYWMGEALKLAQKARDEGEVPVGAILVRKGEVIGHGWNRSIGSHDPSAHAEIMAIREAGVRIGNYRMLDTVLYSTFEPCAMCAGALVHGRISRLVFGVENPKRGACGSVMDIARHPALNHQLQVDGGVMAAPCNRLLCDFFRWRPAQKNAARDNSSGN

SEQ ID NO: 476 - protein, 962 aa, Artificial Sequence
  Description of Artificial Sequence: Synthetic polypeptide
  Category: adenine base editor
  Description: MG68-4_V1-nMG34-1 (D10A)
MTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNGTSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEGSGGSPKKKRKV

SEQ ID NO: 477 - protein, 1589 aa, Artificial Sequence
  Description of Artificial Sequence: Synthetic polypeptide
  Category: adenine base editor
  Description: MG68-4_V1-nSpCas9 (D10A)
MGSSHHHHHHMTDSQNDTDEYWMGEALKLAQKAWDEGEVPVGAILVRKGEVIGHGWNRSIGSHDPSAHAEIMAIREAGVRIGNYRMLDTVLYVTLEPCAMCAGALVHGRISRLVFGAENPKTGACGSVMDIARHPALNHQLQVDGGVMAAPCARLLSDFFRWRRAQKKAARDNSSGNSGGSSGGSSGSETPGTSESATPESSGGSSGGSMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSGGSPKKKRKV

SEQ ID NO: 478 - protein, 1361 aa, Artificial Sequence
  Description of Artificial Sequence: Synthetic polypeptide
  Category: cytosine base editor
  Description: rAPOBEC1-nMG15-1 (D8A)
MGSSHHHHHHGMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESGMNYVLGLAVGIASVGWAVLELNEEDNPIRIEGLGARIFDKAEVPKTGASLAAPRRMSRGIRRVIRRRRFRLQRVRSYLKKHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIEKYLEEGGIGKADGEALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEENFIFSLYPNDLIFVDAGKEIPFKAALKGSTLDPEKKASRFLMYYKGADIATGSISGVNHDETYKARGVGIQSLREIKKCCIDVLGNISFASKEKRQTFRSGGSSSGGGASSGGSPKKKRKV

SEQ ID NO: 479 - protein, 1441 aa, Artificial Sequence
  Description of Artificial Sequence: Synthetic polypeptide
  Category: cytosine base editor
  Description: rAPOBEC1-nMG15-1 (D8A)-UGI (PBS1)
MGSSHHHHHHGMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESGMNYVLGLAVGIASVGWAVLELNEEDNPIRIEGLGARIFDKAEVPKTGASLAAPRRMSRGIRRVIRRRRFRLQRVRSYLKKHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIEKYLEEGGIGKADGEALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEENFIFSLYPNDLIFVDAGKEIPFKAALKGSTLDPEKKASRFLMYYKGADIATGSISGVNHDETYKARGVGIQSLREIKKCCIDVLGNISFASKEKRQTFRSGGSSRTNLSDIIEKETGKQLVIQESILMLPEEVEEVIGNKPESDILVHTAYDESTDENVMLLTSDAPEYKPWALVIQDSNGENKIKMLASSGGSPKKKRKV

SEQ ID NO: 480 - protein, 1442 aa, Artificial Sequence
  Description of Artificial Sequence: Synthetic polypeptide
  Category: cytosine base editor
  Description: rAPOBEC1-nMG15-1 (D8A)-MG69-1
MGSSHHHHHHGMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESGMNYVLGLAVGIASVGWAVLELNEEDNPIRIEGLGARIFDKAEVPKTGASLAAPRRMSRGIRRVIRRRRFRLQRVRSYLKKHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIEKYLEEGGIGKADGEALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEENFIFSLYPNDLIFVDAGKEIPFKAALKGSTLDPEKKASRFLMYYKGADIATGSISGVNHDETYKARGVGIQSLREIKKCCIDVLGNISFASKEKRQTFRSGGSSSKTIKDLEEFAAEKLGYDIVFQESISMEPQEVEHLITTDEKSVLVNSTYDDNKEITISMISTPHPEYRPIALIIQDMEGEVQRKELGSGGSPKKKRKV

SEQ ID NO: 481 - protein, 1443 aa, Artificial Sequence
  Description of Artificial Sequence: Synthetic polypeptide
  Category: cytosine base editor
  Description: rAPOBEC1-nMG15-1 (D8A)-MG69-2
MGSSHHHHHHGMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESGMNYVLGLAVGIASVGWAVLELNEEDNPIRIEGLGARIFDKAEVPKTGASLAAPRRMSRGIRRVIRRRRFRLQRVRSYLKKHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIEKYLEEGGIGKADGEALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEENFIFSLYPNDLIFVDAGKEIPFKAALKGSTLDPEKKASRFLMYYKGADIATGSISGVNHDETYKARGVGIQSLREIKKCCIDVLGNISFASKEKRQTFRSGGSSSKTIKDLEEFAAEKLGYDIVFQESISMEPQEVEHLITTDEKSVLVNSTYDDDKEITISVISTPHPEYRPIALVIQDMEGEVQRKELYGSGGSPKKKRKV

SEQ ID NO: 482 - protein, 1422 aa, Artificial Sequence
  Description of Artificial Sequence: Synthetic polypeptide
  Category: cytosine base editor
  Description: rAPOBEC1-nMG15-1 (D8A)-MG69-
MGSSHHHHHHGMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESGMNYVLGLAVGIASVGWAVLELNEEDNPIRIEGLGARIFDKAEVPKTGASLAAPRRMSRGIRRVIRRRRFRLQRVRSYLKKHNILPAEKVDHLYDVPSAIDIYELRKRALTEKVTAEEWARLLIFFAKHRGFKSNRKKASGDADEGEMLKAIAANAEILKNYRTVGEMLCDNEKFRKRKRNRDGAYNFTVSRAMLMEEIHTLFEIQRNLGQKFADEKLEEEYVILFAAQRKFDEGPGENSPYAGNQIEKMIGSCTLEGKKEKRAPKASYAFMAFNLWQKINHLKVNRRGSERFLTEEERRRIADLAWKKEKLTYGSLRKVLSLDPEDRFVGLRYDLKKGKAENLEEPVSEAEKRSFSWVKDYHSIRKALDKVEKNRILKLSHEQLDTIATAFSVYKNEETIEKYLEEGGIGKADGEALLERLSGFSKFGHLSLKACYKLLPFLEKGEVYSRACELAGYDFSKSSLENIDDIPNPVVKRSISQTLKVINAIILRYGNPVEVHIELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEENFIFSLYPNDLIFVDAGKEIPFKAALKGSTLDPEKKASRFLMYYKGADIATGSISGVNHDETYKARGVGIQSLREIKKCCIDVLGNISFASKEKRQTFRSGGSSIVRVTYNVEQEVEISNKFNKDVDIMKPEEYDDYIDDLMFALNEKLPEYAEISCVINDNTGEVLFEGGSGGSPKKKRKV

SEQ ID NO: 483 - DNA, 10943 bp, Artificial Sequence
  Description of Artificial Sequence: Synthetic polynucleotide
  Category: Plasmid
  Description: pET21-CAT (H193Y)-sgRNA-TadA-nSpCas9 (D10A)
gaaataattttgtttaactttaagaaggagatataccatgggcagcagtcatcatcatcaccatcacatgtctgaagtcgaatttagccacgaatactggatgcgtcacgcgctgacgctggcgaaacgtgcctgggatgagcgggaagtgccggtcggcgcggtattagtgcataacaatcgggtaatcggcgaaggctggaaccgcccgattggtcgccatgatcccaccgcacatgcagaaatcatggccctgcggcagggtggtctggtgatgcaaaattatcgtctgatcgacgccacgttgtatgtcacgcttgaaccatgtgtaatgtgtgccggagcgatgatccacagtcgcattggtcgcgtggtctttggtgcgcgtgacgcgaaaactggcgctgcgggatctttaatggatgtgctgcatcatccgggtatgaatcaccgagtggaaattacggaaggaatactggcggatgagtgcgcggcgttgctcagtgacttctttcgcatgcgccgccaggaaattaaagcgcagaaaaaagcgcaatcctcgacggattcaggcgggtcgtcgggaggaagcagtggcagcgagactcccggaacttcggagagcgctacaccagaaagtagtggaggcagctctggtgggtccatggataagaaatactcaataggactggcgattggcacaaatagcgtcggatgggctgtgatcactgatgaatataaggttccttctaaaaagttcaaggttctgggaaatacagaccgccacagtatcaaaaaaaatcttataggggctcttctgtttgacagtggagagacagccgaagctactagactcaaacggacagctaggagaaggtatacaagacggaagaataggatttgttatctccaggagattttttcaaatgagatggccaaagtggatgatagtttctttcatagacttgaagagtcttttttggtggaagaagacaagaagcatgaaagacatcctatttttggaaatatagtggatgaagttgcttatcacgagaaatatccaactatctatcatctgagaaaaaaattggtggattctactgataaagccgatttgcgcctgatctatttggccctggcccacatgattaagtttagaggtcattttttgattgagggcgatctgaatcctgataatagtgatgtggacaaactgtttatccagttggtgcaaacctacaatcaactgtttgaagaaaaccctattaacgcaagtggagtggatgctaaagccattctttctgcaagattgagtaaatcaagaagactggaaaatctcattgctcagctccccggtgagaagaaaaatggcctgtttgggaatctcattgctttgtcattgggtttgacccctaattttaaatcaaattttgatttggcagaagatgctaaactccagctttcaaaagatacttacgatgatgatctggataatctgttggctcaaattggagatcaatatgctgatttgtttttggcagctaagaatctgtcagatgctattctgctttcagacatcctgagagtgaatactgaaataactaaggctcccctgtcagcttcaatgattaaacgctacgatgaacatcatcaagacttgactcttctgaaagccctggttagacaacaacttccagaaaagtataaagaaatcttttttgatcaatcaaaaaacggatatgcaggttatattgatggcggcgcaagccaagaagaattttataaatttatcaaaccaattctggaaaaaatggatggtactgaggaactgttggtgaaactgaatagagaagatttgctgcgcaagcaacggacctttgacaacggctctattccccatcaaattcacttgggtgagctgcatgctattttgagaagacaagaagacttttatccatttctgaaagacaatagagagaagattgaaaaaatcttgacttttaggattccttattatgttggtccattggccagaggcaatagtaggtttgcatggatgactcggaagtctgaagaaacaattaccccatggaattttgaagaagttgtcgataaaggtgcttcagctcaatcatttattgaacgcatgacaaactttgataaaaatcttccaaatgaaaaagtgctgccaaaacatagtttgctttatgagtattttaccgtttataacgaattgacaaaggtcaaatatgttactgaaggaatgagaaaaccagcatttctttcaggtgaacagaagaaagccattgttgatctgctcttcaaaacaaataggaaagtgaccgttaagcaactgaaagaagattatttcaaaaaaatagaatgttttgatagtgttgaaatttcaggagttgaagatagatttaatgcttcactgggtacataccatgatttgctgaaaattattaaagataaagattttttggataatgaagaaaatgaagacatcctggaggatattgttctgacattgaccctgtttgaagatagggagatgattgaggaaagacttaaaacatacgctcacctctttgatgataaggtgatgaaacagcttaaaagacgcagatatactggttggggaaggttgtccagaaaattgattaatggtattagggataagcaatctggcaaaacaatactggattttttgaaatcagatggttttgccaatcgcaattttatgcagctcatccatgatgatagtttgacatttaaagaagacatccaaaaagcacaagtgtctggacaaggcgatagtctgcatgaacatattgcaaatctggctggtagccctgctattaaaaaaggtattctccagactgtgaaagttgttgatgaattggtcaaagtgatggggcggcataagccagaaaatatcgttattgaaatggcaagagaaaatcagacaactcaaaagggccagaaaaattccagagagaggatgaaaagaatcgaagaaggtatcaaagaactgggaagtcagattcttaaagagcatcctgttgaaaatactcaattgcaaaatgaaaagctctatctctattatctccaaaatggaagagatatgtatgtggaccaagaactggatattaataggctgagtgattatgatgtcgatcacattgttccacaaagtttccttaaagacgattcaatagacaataaggtcctgaccaggtctgataaaaatagaggtaaatccgataacgttccaagtgaagaagtggtcaaaaagatgaaaaactattggagacaacttctgaacgccaagctgatcactcaaaggaagtttgataatctgaccaaagctgaaagaggaggtttgagtgaacttgataaagctggttttatcaaacgccaattggttgaaactcgccaaatcactaagcatgtggcacaaattttggatagtcgcatgaatactaaatacgatgaaaatgataaacttattagagaggttaaagtgattaccctgaaatctaaactggtttctgacttcagaaaagatttccaattctataaagtgagagagattaacaattaccatcatgcccatgatgcctatctgaatgccgtcgttggaactgctttgattaagaaatatccaaaacttgaaagcgagtttgtctatggtgattataaagtttatgatgttaggaaaatgattgctaagtctgagcaagaaataggcaaagcaaccgcaaagtatttcttttactctaatatcatgaacttcttcaaaacagaaattacacttgcaaatggagagattcgcaaacgccctctgatcgaaactaatggggaaactggagaaattgtctgggataaagggagagattttgccacagtgcgcaaagtgttgtccatgccccaagtcaatatcgtcaagaaaacagaagtgcagacaggcggattctctaaggagtcaattctgccaaaaagaaattccgacaagctgattgctaggaaaaaagactgggacccaaaaaaatatggtggttttgatagtccaaccgtggcttattcagtcctggtggttgctaaggtggaaaaagggaaatccaagaagctgaaatccgttaaagagctgctggggatcacaattatggaaagaagttcctttgaaaaaaatcccattgactttctggaagctaaaggatataaggaagttaaaaaagacctgatcattaaactgcctaaatatagtctttttgagctggaaaacggtaggaaacggatgctggctagtgccggagaactgcaaaaaggaaatgagctggctctgccaagcaaatatgtgaattttctgtatctggctagtcattatgaaaagttgaagggtagtccagaagataacgaacaaaaacaattgtttgtggagcagcataagcattatctggatgagattattgagcaaatcagtgaattttctaagagagttattctggcagatgccaatctggataaagttcttagtgcatataacaaacatagagacaaaccaataagagaacaagcagaaaatatcattcatctgtttaccttgaccaatcttggagcacccgctgcttttaaatactttgatacaacaattgataggaaaagatatacctctacaaaagaagttctggatgccactcttatccatcaatccatcactggtctttatgaaacacgcattgatttgagtcagctgggaggtgacggctctggcgggtctcccaagaagaagaggaaagtctaagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtttaattaatttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgttttttgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcattatgccgtctgtgatggcttccatgtcggcagaatgcttaatgaattacaacagtactgcgatgagtggcagggcggggcgtaatttttttaaggcagttattggtgcccttaaacgcctggtgctacgcctgaataagtgaagcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctaggatcc

SEQ ID NO: 484 - DNA, 8520 bp, Artificial Sequence
  Description of Artificial Sequence: Synthetic polynucleotide
  Category: Plasmid
  Description: pET21-sgRNA-TadA (ABE8.17m)-nMG34-1 (D10A)
gaaataattttgtttaactttaagaaggagatataccatgggcagcagtcatcatcatcaccatcactccgaggttgaatttagtcatgaatattggatgcgccacgcgctgacgttagccaaacgtgctcgtgatgagcgcgaagttccagtcggggccgtcttggtccttaacaatcgtgtcattggcgaggggtggaaccgcgctattgggctgcacgatccaacagcgcatgctgagattatggccttgcgtcaaggagggttagtaatgcaaaactaccgtcttattgatgctacgttatactctacattcgaaccctgtgtaatgtgtgcaggagcgatgatccacagtcgtattggccgcgtagtatttggtgtacgcaatgctaaaactggagccgccggatcgttgatggatgtcttgcattaccctggaatgaaccatcgtgtagagatcactgaaggcatccttgccgatgagtgtgcggctttgctttgctatttcttccgtatgccacgtcgtgtttttaacgcccaaaaaaaggctcaatccagtaccgattcaggcgggtcgtcgggaggaagcagtggcagcgagactcccggaacttcggagagcgctacaccagaaagtagtggaggcagctctggtgggtccatggagcgcgagctggtgctggggatcgcgtatggtggtaagtacacgggcttggcggtggtggatcgccgccacaaccaagtgctgtacgcgaatcgtcttaaaatgcgtgatgacgtggcaggcatcttgaaggaccgtcgcaaacagcgcgggattcgtcgcacggcccagacgaagaagaaacgccttcgcgagctgaagaattacctgaagagcatcgggtacaatgagtcgacggccaccttcgagaccgtgtattcactggcgcacaagcgtggttacgactacgcagacatgccagaggagaaaaccagtgaggagattgaagcgatggacgttgaggaacgtaagcaatgggagaaggaaaagcaagagtgggaagaaactaagcgcaactctcgccatcgcaaagaggtagttaaggacgtacacaaggcgatgatcgagggccgtgccacggaagaacaaattaagcgtgtggagcgcatcttcaacaagcaatatcgcccgaagcgttttaacaaccgcatcttgaccaagtgcaaagtggaagactgtggtgtgaacactcctttgcgtaagaacgtacgcgacctgctgattgagaacattgttcgtttctttccgattgagcagagcgagaaagacaacctgaaggacgccgtattagacaagaatcgtcgcgaagaggtgaagtccttctttcgcaagcacaaaaccgacgagcacatccgtaaacaagtgtacgacattgccgacaataaactgagcgggcgtactgtattctgcaaggagcacattctggagcacacggaacactccaaggaagagcgtaaagtctttcgcctggcaccgagtctgaagacgaagattgaaaacgtgctggcagtaatcaaggatgaaattctccctaagttcacggtgaacaaagtagtgatggaatcaaataacttcgacatcgccgcgaagacccaaggtaagaagcgtctcgccaaggaagagtacggcaagggcccgcgtgagggtaaggaaacgcgcaaagaggcgctgctgcgcgagaccgacgggcgctgcatttattgcggcaagagcatcgatatttcgaacgcacacgacgatcacatcttccctcgtaaagcgggcggattgaacattttcgcgaacctcgtggcctgctgtgcggtgtgcaacgaaaacaagaagggccgcacgcctctggagtcgggcatttcaccaaagccagagattattgcatttatgaagaacgacctgaagaagaaaatcttggaagatgctcgcaacattaacaccgtcgacttcaacaagtatatgagccacgcttcgattgggtggcgttacatgcgcgatcgccttcgcgaatcggcaggtaacaagaaactgccgatcgaacgccaaagtggtatttatacggcctactttcgtcgctggtggggtttcaagaaagagcgcggtaatactttgcaccacgctctggacgcggtgattttggcctcgcgtaagggctactcagacgacggcttagtagacatgactttaaaacccaagtacaataagggcggcgaattcgatccggagaagcacttaccggagcctatcgagttcaagatggacaaggggtcacgcggtagcgccctgcacgaccgtaatccgttgagttacaagaagggtatcatcactcgtcgcttcatggtcactgaaatcgaatgtggcaaggaagatgacgtgatctctgaaacctaccgcgagaagttgaaggaagcgttcaagcgcttcgacaccaagaagggcaagtgcctgaccgataaagaagccaaagaggcggggttctgtatcaagaagaacgagctggtgatgtcgctgaagtgttcaatcaaggggactggcccgggccaaatgattcgcattaacaacaacgtgttcaaaaccaacgtacacaacgtaggagttgacgtctacctggacgagaagggcaagaagaaggcgtacgaacgcaagaacccacgcttatcgaagcattttattgagccgccgccacaaccgaacggccgcgtctctttcacactgaagcgtcgcgacatggtgactgtagagggagaggatgccatttaccgcattaagaagttgggtacttccccgaccatcgaggcggtggtggggagcgacggtaagacgcgcacagtatcggcaacgaaattgaccaaggccaatagcgccgagctcgagggctctggcgggtctcccaagaagaagaggaaagtctaagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtttaattaattacggccagtcatgcataatccgcacgcatctggaataaggaagtgccattccgcctgaccttaatacgactcactatagtctttatggcagggtgaaacgcgttacagttaagaaattaattgtaaaacgcctatacagtgaagggatatacgcttgggtttgtccagcctgagcctctatgccagaaatggcgccttcatcgtgggttaggacatttaattttaaaaaaaaaccccgcttcggcggggtttttttttagcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctaggatcc

SEQ ID NO: 485 - DNA, 8925 bp, Artificial Sequence
  Description of Artificial Sequence: Synthetic polynucleotide
  Category: Plasmid
  Description: pET21-sgRNA-rAPOBEC1-nMG34-1 (D10A)-UGI (PBS1)
atgggcagcagtcatcatcatcaccatcacatgtcgtctgagaccgggcctgttgccgtggaccctacccttcgccgccgtatcgaaccacacgagtttgaagtgttttttgacccacgcgaactgcgcaaagagacttgtttgctttacgagattaactggggaggccgtcactccatctggcgtcacacttcacaaaatactaataagcacgttgaggttaatttcattgagaaatttactacagagcgctacttctgtccgaatacacgttgcagcatcacctggtttctttcctggtccccgtgcggtgaatgttcacgtgccatcaccgaattcttatcgcgctaccctcacgtaactttgtttatctatattgcccgtttatatcaccatgcagaccctcgcaatcgtcagggcctgcgcgaccttatctcgagtggagtcaccatccaaattatgactgaacaggaatcggggtattgttggcgcaactttgtcaattattctccgagcaacgaggcacattggccgcgttacccacacttatgggtgcgcctttacgtgctggaattgtattgcatcattcttggtcttcccccatgtttgaatatccttcgccgcaaacagcctcagttgacgttttttacgattgctcttcagtcctgtcactaccaacgtcttcccccgcacatcctgtgggcgaccggtttgaaatcggggagtgaaacacccggcacatccgaaagtgcgacacctgaatctgccatggagcgcgagctggtgctggggatcgcgtatggtggtaagtacacgggcttggcggtggtggatcgccgccacaaccaagtgctgtacgcgaatcgtcttaaaatgcgtgatgacgtggcaggcatcttgaaggaccgtcgcaaacagcgcgggattcgtcgcacggcccagacgaagaagaaacgccttcgcgagctgaagaattacctgaagagcatcgggtacaatgagtcgacggccaccttcgagaccgtgtattcactggcgcacaagcgtggttacgactacgcagacatgccagaggagaaaaccagtgaggagattgaagcgatggacgttgaggaacgtaagcaatgggagaaggaaaagcaagagtgggaagaaactaagcgcaactctcgccatcgcaaagaggtagttaaggacgtacacaaggcgatgatcgagggccgtgccacggaagaacaaattaagcgtgtggagcgcatcttcaacaagcaatatcgcccgaagcgttttaacaaccgcatcttgaccaagtgcaaagtggaagactgtggtgtgaacactcctttgcgtaagaacgtacgcgacctgctgattgagaacattgttcgtttctttccgattgagcagagcgagaaagacaacctgaaggacgccgtattagacaagaatcgtcgcgaagaggtgaagtccttctttcgcaagcacaaaaccgacgagcacatccgtaaacaagtgtacgacattgccgacaataaactgagcgggcgtactgtattctgcaaggagcacattctggagcacacggaacactccaaggaagagcgtaaagtctttcgcctggcaccgagtctgaagacgaagattgaaaacgtgctggcagtaatcaaggatgaaattctccctaagttcacggtgaacaaagtagtgatggaatcaaataacttcgacatcgccgcgaagacccaaggtaagaagcgtctcgccaaggaagagtacggcaagggcccgcgtgagggtaaggaaacgcgcaaagaggcgctgctgcgcgagaccgacgggcgctgcatttattgcggcaagagcatcgatatttcgaacgcacacgacgatcacatcttccctcgtaaagcgggcggattgaacattttcgcgaacctcgtggcctgctgtgcggtgtgcaacgaaaacaagaagggccgcacgcctctggagtcgggcatttcaccaaagccagagattattgcatttatgaagaacgacctgaagaagaaaatcttggaagatgctcgcaacattaacaccgtcgacttcaacaagtatatgagccacgcttcgattgggtggcgttacatgcgcgatcgccttcgcgaatcggcaggtaacaagaaactgccgatcgaacgccaaagtggtatttatacggcctactttcgtcgctggtggggtttcaagaaagagcgcggtaatactttgcaccacgctctggacgcggtgattttggcctcgcgtaagggctactcagacgacggcttagtagacatgactttaaaacccaagtacaataagggcggcgaattcgatccggagaagcacttaccggagcctatcgagttcaagatggacaaggggtcacgcggtagcgccctgcacgaccgtaatccgttgagttacaagaagggtatcatcactcgtcgcttcatggtcactgaaatcgaatgtggcaaggaagatgacgtgatctctgaaacctaccgcgagaagttgaaggaagcgttcaagcgcttcgacaccaagaagggcaagtgcctgaccgataaagaagccaaagaggcggggttctgtatcaagaagaacgagctggtgatgtcgctgaagtgttcaatcaaggggactggcccgggccaaatgattcgcattaacaacaacgtgttcaaaaccaacgtacacaacgtaggagttgacgtctacctggacgagaagggcaagaagaaggcgtacgaacgcaagaacccacgcttatcgaagcattttattgagccgccgccacaaccgaacggccgcgtctctttcacactgaagcgtcgcgacatggtgactgtagagggagaggatgccatttaccgcattaagaagttgggtacttccccgaccatcgaggcggtggtggggagcgacggtaagacgcgcacagtatcggcaacgaaattgaccaaggccaatagcgccgagctcgaggggtctggtggttctaccaatctttcagatattattgaaaaagagacaggaaagcagttggtcattcaagagagtatcctgatgttaccggaggaagttgaggaggtaatcggaaataaacccgagagcgacattttagtccacactgcttatgacgagagtacggatgagaatgtgatgctgcttacgtcagatgcgcccgagtataagccgtgggccctggtcattcaggacagtaacggcgaaaacaagatcaaaatgctttctggtggttctcccaagaagaagaggaaagtctaagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtttaattaattacggccagtcatgcataatccgcacgcatctggaataaggaagtgccattccgcctgaccttaatacgactcactatagcgcgccggagaaaaccgcctcggttacagttaagaaattaattgtaaaacgcctatacagtgaagggatatacgcttgggtttgtccagcctgagcctctatgccagaaatggcgccttcatcgtgggttaggacatttaattttaaaaaaaaaccccgcttcggcggggtttttttttagcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctaggatccgaaataattttgtttaactttaagaaggagatatacc

SEQ ID NO: 486 - DNA, 9519 bp, Artificial Sequence
  Description of Artificial Sequence: Synthetic polynucleotide
  Category: Plasmid
  Description: pET21-CAT (H193Y)-sgRNA-MG68-4 (D109N)-nMG34-1 (D10A)
ttaattaatttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgttttttgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcattatgccgtctgtgatggcttccatgtcggcagaatgcttaatgaattacaacagtactgcgatgagtggcagggcggggcgtaatttttttaaggcagttattggtgcccttaaacgcctggtgctacgcctgaataagtgaagcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgactcgagtgcggccgcaagcttgtcgacggagctcgaattcggatcctaatacgactcactatagtaatgaacctgaatcgccaggttacagttaagaaattaattgtaaaacgcctatacagtgaagggatatacgcttgggtttgtccagcctgagcctctatgccagaaatggcgccttcatcgtgggttaggacatttaattttaaaaaaaaaccccgcttcggcggggtttttttttagcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctaggatccgaaataattttgtttaactttaagaaggagatataccccgcggatgactgattctcaaaatgatacagatgaatactggatgggagaggccctgaagttggcacaaaaggcatgggacgaaggagaggtgcccgtaggagccatcttggttcgtaagggcgaagttatcggtcatggctggaaccgtagcatcgggtcccatgacccctcggcgcatgctgaaattatggctattcgtgaagccggggtgcgtatcggtaattatcgcatgttggataccgtattatacgttacgctggagccgtgtgcaatgtgcgcaggggcacttgttcacgggcgtatttcacgcttggtctttggtgccgaaaaccccaagacaggggcgtgcgggtcagtcatggacattgctcgccaccctgctttgaaccaccaattacaagttgatggtggggtaatggcggctccttgtgcgcgtcttttatctgacttctttcgctggcgtcgcgctcagaaaaaggcggcccgtgataatagttcggggaacggtacctcaggcgggtcgtcgggaggaagcagtggcagcgagactcccggaacttcggagagcgctacaccagaaagtagtggaggcagctctggtgggtccatggagcgcgagctggtgctggggatcgcgtatggtggtaagtacacgggcttggcggtggtggatcgccgccacaaccaagtgctgtacgcgaatcgtcttaaaatgcgtgatgacgtggcaggcatcttgaaggaccgtcgcaaacagcgcgggattcgtcgcacggcccagacgaagaagaaacgccttcgcgagctgaagaattacctgaagagcatcgggtacaatgagtcgacggccaccttcgagaccgtgtattcactggcgcacaagcgtggttacgactacgcagacatgccagaggagaaaaccagtgaggagattgaagcgatggacgttgaggaacgtaagcaatgggagaaggaaaagcaagagtgggaagaaactaagcgcaactctcgccatcgcaaagaggtagttaaggacgtacacaaggcgatgatcgagggccgtgccacggaagaacaaattaagcgtgtggagcgcatcttcaacaagcaatatcgcccgaagcgttttaacaaccgcatcttgaccaagtgcaaagtggaagactgtggtgtgaacactcctttgcgtaagaacgtacgcgacctgctgattgagaacattgttcgtttctttccgattgagcagagcgagaaagacaacctgaaggacgccgtattagacaagaatcgtcgcgaagaggtgaagtccttctttcgcaagcacaaaaccgacgagcacatccgtaaacaagtgtacgacattgccgacaataaactgagcgggcgtactgtattctgcaaggagcacattctggagcacacggaacactccaaggaagagcgtaaagtctttcgcctggcaccgagtctgaagacgaagattgaaaacgtgctggcagtaatcaaggatgaaattctccctaagttcacggtgaacaaagtagtgatggaatcaaataacttcgacatcgccgcgaagacccaaggtaagaagcgtctcgccaaggaagagtacggcaagggcccgcgtgagggtaaggaaacgcgcaaagaggcgctgctgcgcgagaccgacgggcgctgcatttattgcggcaagagcatcgatatttcgaacgcacacgacgatcacatcttccctcgtaaagcgggcggattgaacattttcgcgaacctcgtggcctgctgtgcggtgtgcaacgaaaacaagaagggccgcacgcctctggagtcgggcatttcaccaaagccagagattattgcatttatgaagaacgacctgaagaagaaaatcttggaagatgctcgcaacattaacaccgtcgacttcaacaagtatatgagccacgcttcgattgggtggcgttacatgcgcgatcgccttcgcgaatcggcaggtaacaagaaactgccgatcgaacgccaaagtggtatttatacggcctactttcgtcgctggtggggtttcaagaaagagcgcggtaatactttgcaccacgctctggacgcggtgattttggcctcgcgtaagggctactcagacgacggcttagtagacatgactttaaaacccaagtacaataagggcggcgaattcgatccggagaagcacttaccggagcctatcgagttcaagatggacaaggggtcacgcggtagcgccctgcacgaccgtaatccgttgagttacaagaagggtatcatcactcgtcgcttcatggtcactgaaatcgaatgtggcaaggaagatgacgtgatctctgaaacctaccgcgagaagttgaaggaagcgttcaagcgcttcgacaccaagaagggcaagtgcctgaccgataaagaagccaaagaggcggggttctgtatcaagaagaacgagctggtgatgtcgctgaagtgttcaatcaaggggactggcccgggccaaatgattcgcattaacaacaacgtgttcaaaaccaacgtacacaacgtaggagttgacgtctacctggacgagaagggcaagaagaaggcgtacgaacgcaagaacccacgcttatcgaagcattttattgagccgccgccacaaccgaacggccgcgtctctttcacactgaagcgtcgcgacatggtgactgtagagggagaggatgccatttaccgcattaagaagttgggtacttccccgaccatcgaggcggtggtggggagcgacggtaagacgcgcacagtatcggcaacgaaattgaccaaggccaatagcgccgagctcgagggctctggcgggtctcccaagaagaagaggaaagtctaagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtttaattaattctaga

SEQ ID NO: 487 - DNA, 11211 bp, Artificial Sequence
  Description of Artificial Sequence: Synthetic polynucleotide
  Category: Plasmid
  Description: pET21-CAT (H193Y)-sgRNA-MG68-4 (D109N)-nSpCas9 (D10A)
gaaataattttgtttaactttaagaaggagatataccatgggcagcagtcatcatcatcaccatcacatgactgattctcaaaatgatacagatgaatactggatgggagaggccctgaagttggcacaaaaggcatgggacgaaggagaggtgcccgtaggagccatcttggttcgtaagggcgaagttatcggtcatggctggaaccgtagcatcgggtcccatgacccctcggcgcatgctgaaattatggctattcgtgaagccggggtgcgtatcggtaattatcgcatgttggataccgtattatacgttacgctggagccgtgtgcaatgtgcgcaggggcacttgttcacgggcgtatttcacgcttggtctttggtgccgaaaaccccaagacaggggcgtgcgggtcagtcatggacattgctcgccaccctgctttgaaccaccaattacaagttgatggtggggtaatggcggctccttgtgcgcgtcttttatctgacttctttcgctggcgtcgcgctcagaaaaaggcggcccgtgataatagttcggggaactcaggcgggtcgtcgggaggaagcagtggcagcgagactcccggaacttcggagagcgctacaccagaaagtagtggaggcagctctggtgggtccatggataagaaatactcaataggactggcgattggcacaaatagcgtcggatgggctgtgatcactgatgaatataaggttccttctaaaaagttcaaggttctgggaaatacagaccgccacagtatcaaaaaaaatcttataggggctcttctgtttgacagtggagagacagccgaagctactagactcaaacggacagctaggagaaggtatacaagacggaagaataggatttgttatctccaggagattttttcaaatgagatggccaaagtggatgatagtttctttcatagacttgaagagtcttttttggtggaagaagacaagaagcatgaaagacatcctatttttggaaatatagtggatgaagttgcttatcacgagaaatatccaactatctatcatctgagaaaaaaattggtggattctactgataaagccgatttgcgcctgatctatttggccctggcccacatgattaagtttagaggtcattttttgattgagggcgatctgaatcctgataatagtgatgtggacaaactgtttatccagttggtgcaaacctacaatcaactgtttgaagaaaaccctattaacgcaagtggagtggatgctaaagccattctttctgcaagattgagtaaatcaagaagactggaaaatctcattgctcagctccccggtgagaagaaaaatggcctgtttgggaatctcattgctttgtcattgggtttgacccctaattttaaatcaaattttgatttggcagaagatgctaaactccagctttcaaaagatacttacgatgatgatctggataatctgttggctcaaattggagatcaatatgctgatttgtttttggcagctaagaatctgtcagatgctattctgctttcagacatcctgagagtgaatactgaaataactaaggctcccctgtcagcttcaatgattaaacgctacgatgaacatcatcaagacttgactcttctgaaagccctggttagacaacaacttccagaaaagtataaagaaatcttttttgatcaatcaaaaaacggatatgcaggttatattgatggcggcgcaagccaagaagaattttataaatttatcaaaccaattctggaaaaaatggatggtactgaggaactgttggtgaaactgaatagagaagatttgctgcgcaagcaacggacctttgacaacggctctattccccatcaaattcacttgggtgagctgcatgctattttgagaagacaagaagacttttatccatttctgaaagacaatagagagaagattgaaaaaatcttgacttttaggattccttattatgttggtccattggccagaggcaatagtaggtttgcatggatgactcggaagtctgaagaaacaattaccccatggaattttgaagaagttgtcgataaaggtgcttcagctcaatcatttattgaacgcatgacaaactttgataaaaatcttccaaatgaaaaagtgctgccaaaacatagtttgctttatgagtattttaccgtttataacgaattgacaaaggtcaaatatgttactgaaggaatgagaaaaccagcatttctttcaggtgaacagaagaaagccattgttgatctgctcttcaaaacaaataggaaagtgaccgttaagcaactgaaagaagattatttcaaaaaaatagaatgttttgatagtgttgaaatttcaggagttgaagatagatttaatgcttcactgggtacataccatgatttgctgaaaattattaaagataaagattttttggataatgaagaaaatgaagacatcctggaggatattgttctgacattgaccctgtttgaagatagggagatgattgaggaaagacttaaaacatacgctcacctctttgatgataaggtgatgaaacagcttaaaagacgcagatatactggttggggaaggttgtccagaaaattgattaatggtattagggataagcaatctggcaaaacaatactggattttttgaaatcagatggttttgccaatcgcaattttatgcagctcatccatgatgatagtttgacatttaaagaagacatccaaaaagcacaagtgtctggacaaggcgatagtctgcatgaacatattgcaaatctggctggtagccctgctattaaaaaaggtattctccagactgtgaaagttgttgatgaattggtcaaagtgatggggcggcataagccagaaaatatcgttattgaaatggcaagagaaaatcagacaactcaaaagggccagaaaaattccagagagaggatgaaaagaatcgaagaaggtatcaaagaactgggaagtcagattcttaaagagcatcctgttgaaaatactcaattgcaaaatgaaaagctctatctctattatctccaaaatggaagagatatgtatgtggaccaagaactggatattaataggctgagtgattatgatgtcgatcacattgttccacaaagtttccttaaagacgattcaatagacaataaggtcctgaccaggtctgataaaaatagaggtaaatccgataacgttccaagtgaagaagtggtcaaaaagatgaaaaactattggagacaacttctgaacgccaagctgatcactcaaaggaagtttgataatctgaccaaagctgaaagaggaggtttgagtgaacttgataaagctggttttatcaaacgccaattggttgaaactcgccaaatcactaagcatgtggcacaaattttggatagtcgcatgaatactaaatacgatgaaaatgataaacttattagagaggttaaagtgattaccctgaaatctaaactggtttctgacttcagaaaagatttccaattctataaagtgagagagattaacaattaccatcatgcccatgatgcctatctgaatgccgtcgttggaactgctttgattaagaaatatccaaaacttgaaagcgagtttgtctatggtgattataaagtttatgatgttaggaaaatgattgctaagtctgagcaagaaataggcaaagcaaccgcaaagtatttcttttactctaatatcatgaacttcttcaaaacagaaattacacttgcaaatggagagattcgcaaacgccctctgatcgaaactaatggggaaactggagaaattgtctgggataaagggagagattttgccacagtgcgcaaagtgttgtccatgccccaagtcaatatcgtcaagaaaacagaagtgcagacaggcggattctctaaggagtcaattctgccaaaaagaaattccgacaagctgattgctaggaaaaaagactgggacccaaaaaaatatggtggttttgatagtccaaccgtggcttattcagtcctggtggttgctaaggtggaaaaagggaaatccaagaagctgaaatccgttaaagagctgctggggatcacaattatggaaagaagttcctttgaaaaaaatcccattgactttctggaagctaaaggatataaggaagttaaaaaagacctgatcattaaactgcctaaatatagtctttttgagctggaaaacggtaggaaacggatgctggctagtgccggagaactgcaaaaaggaaatgagctggctctgccaagcaaatatgtgaattttctgtatctggctagtcattatgaaaagttgaagggtagtccagaagataacgaacaaaaacaattgtttgtggagcagcataagcattatctggatgagattattgagcaaatcagtgaattttctaagagagttattctggcagatgccaatctggataaagttcttagtgcatataacaaacatagagacaaaccaataagagaacaagcagaaaatatcattcatctgtttaccttgaccaatcttggagcacccgctgcttttaaatactttgatacaacaattgataggaaaagatatacctctacaaaagaagttctggatgccactcttatccatcaatccatcactggtctttatgaaacacgcattgatttgagtcagctgggaggtgacggctctggcgggtctcccaagaagaagaggaaagtctaagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcaatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtttaattaatttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgttttttgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcattatgccgtctgtgatggcttccatgtcggcagaatgcttaatgaattacaacagtactgcgatgagtggcagggcggggcgtaatttttttaaggcagttattggtgcccttaaacgcctggtgctacgcctgaataagtgaagcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgactcgagtgcggccgcaagcttgtcgacggagctcgaattcggatcctaatacgactcactatagtaatgaacctgaatcgccaggttttagagctagaaatagcaagttaaaataaggctagtccgttatcaacttgaaaaagtggcaccgagtcggtgcttttttgtgaacctgcaggaggcatcaaataaaacgaaaggctcagtcgaaagactgggcctttcgttttatctgttgtttgtcggtgaacgctctcctgagtaggacaaattcgatcccgcgaaattaatacgactcactataggggaattgtgagcggataacaattcccctctaggatcc

SEQ ID NO: 488 - DNA, 96 bp, Artificial Sequence
  Description of Artificial Sequence: Synthetic oligonucleotide
  Category: sgRNA scaffold sequence
  Description: MG15-1
gttgtaattccctagaaataggttattacaataaggtccaacaggagtgttggtaccgtaaagctctaacggcacccacgggtgccgttatctttt

SEQ ID NO: 489 - DNA, 123 bp, Artificial Sequence
  Description of Artificial Sequence: Synthetic polynucleotide
  Category: sgRNA scaffold sequence
  Description: MG34-1
gttacagttaagaaattaattgtaaaacgcctatacagtgaagggatatacgcttgggtttgtccagcctgagcctctatgccagaaatggcgccttcatcgtgggttaggacatttaatttt

SEQ ID NO: 490 - DNA, 22 bp, Artificial Sequence
  Description of Artificial Sequence: Synthetic oligonucleotide
  Category: spacer
  Description: rAPOBEC1-nMG15-1 (D8A) in E. coli
gatccgcgctggctaccggcga

SEQ ID NO: 491 - DNA, 22 bp, Artificial Sequence
  Description of Artificial Sequence: Synthetic oligonucleotide
  Category: spacer
  Description: rAPOBEC1-nMG15-1 (D8A)-UGI (PBS1) in E. coli
gatccgcgctggctaccggcga

SEQ ID NO: 492 - DNA, 22 bp, Artificial Sequence
  Description of Artificial Sequence: Synthetic oligonucleotide
  Category: spacer
  Description: rAPOBEC1-nMG15-1 (D8A)-MG69-1 in E. coli
gatccgcgctggctaccggcga

SEQ ID NO: 493 - DNA, 22 bp, Artificial Sequence
  Description of Artificial Sequence: Synthetic oligonucleotide
  Category: spacer
  Description: rAPOBEC1-nMG15-1 (D8A)-MG69-2 in E. coli
gatccgcgctggctaccggcga

SEQ ID NO: 494 - DNA, 22 bp, Artificial Sequence
  Description of Artificial Sequence: Synthetic oligonucleotide
  Category: spacer
  Description: rAPOBEC1-nMG15-1 (D8A)-MG69-3 in E. coli
gatccgcgctggctaccggcga

SEQ ID NO: 495 - DNA, 20 bp, Artificial Sequence
  Description of Artificial Sequence: Synthetic oligonucleotide
  Category: spacer
  Description: rAPOBEC1-nSpCas9 (D10A)-UGI (PBS1) in HEK293T
ggcccagactgagcacgtga

SEQ ID NO: 496 - DNA, 20 bp, Artificial Sequence
  Description of Artificial Sequence: Synthetic oligonucleotide
  Category: spacer
  Description: rAPOBEC1-nSpCas9 (D10A) in HEK293T
ggcccagactgagcacgtga

SEQ ID NO: 497 - DNA, 20 bp, Artificial Sequence
  Description of Artificial Sequence: Synthetic oligonucleotide
  Category: spacer
  Description: rAPOBEC1-nSpCas9 (D10A)-MG69-1 in HEK293T
ggcccagactgagcacgtga

SEQ ID NO: 498 - DNA, 20 bp, Artificial Sequence
  Description of Artificial Sequence: Synthetic oligonucleotide
  Category: spacer
  Description: rAPOBEC1-nSpCas9 (D10A)-MG69-2 in HEK293T
ggcccagactgagcacgtga

SEQ ID NO: 499 - DNA, 22 bp, Artificial Sequence
  Description of Artificial Sequence: Synthetic oligonucleotide
  Category: spacer
  Description: A0A2K5RDN7-nMG1-4 (D9A)-MG69-1_site 1 in HEK293T
gattcccacctctcaatacgtt

SEQ ID NO: 500 - DNA, 22 bp, Artificial Sequence
  Description of Artificial Sequence: Synthetic oligonucleotide
  Category: spacer
  Description: A0A2K5RDN7-nMG1-4 (D9A)-MG69-1_site 2 in HEK293T
cccaggcaggcaggctctccga

SEQ ID NO: 501 - DNA, 22 bp, Artificial Sequence
  Description of Artificial Sequence: Synthetic oligonucleotide
  Category: spacer
  Description: A0A2K5RDN7-nMG1-4 (D9A)-MG69-1_site 3 in HEK293T
caccccctctccctccatcagt

SEQ ID NO: 502 - DNA, 22 bp, Artificial Sequence
  Description of Artificial Sequence: Synthetic oligonucleotide
  Category: spacer
  Description: A0A2K5RDN7-nMG1-4 (D9A)-MG69-1_site 4 in HEK293T
tgtacacagtttcccaagctac

SEQ ID NO: 503 - DNA, 22 bp, Artificial Sequence
  Description of Artificial Sequence: Synthetic oligonucleotide
  Category: spacer
  Description: A0A2K5RDN7-nMG3-6 (D13A)-MG69-1_site 1 in HEK293T
ctggactctggccactccctgg

SEQ ID NO: 504 - DNA, 22 bp, Artificial Sequence
  Description of Artificial Sequence: Synthetic oligonucleotide
  Category: spacer
  Description: A0A2K5RDN7-nMG3-6 (D13A)-MG69-1_site 2 in HEK293T
catccagctccagccccagagc

SEQ ID NO: 505 - DNA, 22 bp, Artificial Sequence
  Description of Artificial Sequence: Synthetic oligonucleotide
  Category: spacer
  Description: A0A2K5RDN7-nMG3-6 (D13A)-MG69-1_site 3 in HEK293T
gattccggctctgagggccagt

SEQ ID NO: 506 - DNA, 22 bp, Artificial Sequence
  Description of Artificial Sequence: Synthetic oligonucleotide
  Category: spacer
  Description: A0A2K5RDN7-nMG3-6 (D13A)-MG69-1_site 4 in HEK293T
gcccttctgtttgtcccacttg

SEQ ID NO: 507 - DNA, 22 bp, Artificial Sequence
  Description of Artificial Sequence: Synthetic oligonucleotide
  Category: spacer
  Description: A0A2K5RDN7-nMG3-6 (D13A)-MG69-1_site 5 in HEK293T
ttggccaagccaggcctagaat

SEQ ID NO: 508 - DNA, 22 bp, Artificial Sequence
  Description of Artificial Sequence: Synthetic oligonucleotide
  Category: spacer
  Description: A0A2K5RDN7-nMG3-6 (D13A)-MG69-1_site 6 in HEK293T
ctcagctggtacacggcagggt

SEQ ID NO: 509 - DNA, 22 bp, Artificial Sequence
  Description of Artificial Sequence: Synthetic oligonucleotide
  Category: spacer
  Description: A0A2K5RDN7-nMG3-6 (D13A)-MG69-1_site 7 in HEK293T
tcgcctatgggaactctggagg

SEQ ID NO: 510 - DNA, 22 bp, Artificial Sequence
  Description of Artificial Sequence: Synthetic oligonucleotide
  Category: spacer
  Description: A0A2K5RDN7-nMG4-2 (D28A)-MG69-1_site 1 in HEK293T
cctaacatggataagtccagat

SEQ ID NO: 511 - DNA, 22 bp, Artificial Sequence
  Description of Artificial Sequence: Synthetic oligonucleotide
  Category: spacer
  Description: A0A2K5RDN7-nMG4-2 (D28A)-MG69-1_site 2 in HEK293T
ggccctcagagccggaatctac

SEQ ID NO: 512 - DNA, 22 bp, Artificial Sequence
  Description of Artificial Sequence: Synthetic oligonucleotide
  Category: spacer
  Description: A0A2K5RDN7-nMG4-2 (D28A)-MG69-1_site 3 in HEK293T
tgtcctccctcaagatacagga

SEQ ID NO: 513 - DNA, 22 bp, Artificial Sequence
  Description of Artificial Sequence: Synthetic oligonucleotide
  Category: spacer
  Description: A0A2K5RDN7-nMG4-2 (D28A)-MG69-1_site 4 in HEK293T
tgtgttcacctgcccttctgtt

SEQ ID NO: 514 - DNA, 22 bp, Artificial Sequence
  Description of Artificial Sequence: Synthetic oligonucleotide
  Category: spacer
  Description: A0A2K5RDN7-nMG18-1 (D12A)-MG69-1_site 1 in HEK293T
cagtgtcccccttccctatggg

SEQ ID NO: 515 - DNA, 22 bp, Artificial Sequence
  Description of Artificial Sequence: Synthetic oligonucleotide
  Category: spacer
  Description: A0A2K5RDN7-nMG18-1 (D12A)-MG69-1_site 2 in HEK293T
cccccttccctatgggaataat

SEQ ID NO: 516 - DNA, 22 bp, Artificial Sequence
  Description of Artificial Sequence: Synthetic oligonucleotide
  Category: spacer
  Description: A0A2K5RDN7-nMG18-1 (D12A)-MG69-1_site 3 in HEK293T
cagctccagccccagagcctgg

SEQ ID NO: 517 - DNA, 22 bp, Artificial Sequence
  Description of Artificial Sequence: Synthetic oligonucleotide
  Category: spacer
  Description: A0A2K5RDN7-nMG18-1 (D12A)-MG69-1_site 4 in HEK293T
gtgcctctccctgcagacggta

SEQ ID NO: 518 - DNA, 20 bp, Artificial Sequence
  Description of Artificial Sequence: Synthetic oligonucleotide
  Category: spacer
  Description: A0A2K5RDN7-nSpCas9 (D10A)-MG69-1_site 1 in HEK293T
ttgccacgaagcaggccaat

SEQ ID NO: 519 - DNA, 20 bp, Artificial Sequence
  Description of Artificial Sequence: Synthetic oligonucleotide
  Category: spacer
  Description: A0A2K5RDN7-nSpCas9 (D10A)-MG69-1_site 2 in HEK293T
cccggggccgccattgacag

SEQ ID NO: 520 - DNA, 20 bp, Artificial Sequence
  Description of Artificial Sequence: Synthetic oligonucleotide
  Category: spacer
  Description: A0A2K5RDN7-nSpCas9 (D10A)-MG69-1_site 3 in HEK293T
tccggctctgagggccagtg

SEQ ID NO: 521 - DNA, 20 bp, Artificial Sequence
  Description of Artificial Sequence: Synthetic oligonucleotide
  Category: spacer
  Description: A0A2K5RDN7-nSpCas9 (D10A)-MG69-1_site 4 in HEK293T
caaccagtccccagtgactc

SEQ ID NO: 522 - DNA, 20 bp, Artificial Sequence
  Description of Artificial Sequence: Synthetic oligonucleotide
  Category: spacer
  Description: A0A2K5RDN7-nSpCas9 (D10A)-MG69-1_site 5 in HEK293T
gagtccgagcagaagaagaa

SEQ ID NO: 523 - DNA, 21 bp, Artificial Sequence
  Description of Artificial Sequence: Synthetic primer
  Category: primer
  Description: Forward primer used to amplify lacZ of E. coli and Sanger sequencing
ccaggctttacactttatgct

SEQ ID NO: 524 - DNA, 25 bp, Artificial Sequence
  Description of Artificial Sequence: Synthetic primer
  Category: primer
  Description: Reverse primer used to amplify lacZ of E. coli and Sanger sequencing
cgaacatccaaaagtttgtgttttt

SEQ ID NO: 525 - DNA, 18 bp, Artificial Sequence
  Description of Artificial Sequence: Synthetic primer
  Category: primer
  Description: Sanger sequencing of base edit of lacZ of E. coli
ccgaaaggcgcggtgccg

SEQ ID NO: 526 - DNA, 19 bp, Artificial Sequence
  Description of Artificial Sequence: Synthetic primer
  Category: primer
  Description: Sanger sequencing of base edit of lacZ of E. coli
gtatgtggtggatgaagcc

SEQ ID NO: 527 - DNA, 18 bp, Artificial Sequence
  Description of Artificial Sequence: Synthetic primer
  Category: primer
  Description: Sanger sequencing of base edit of lacZ of E. coli
ttgtggagcgacatccag

SEQ ID NO: 528 - DNA, 19 bp, Artificial Sequence
  Description of Artificial Sequence: Synthetic primer
  Category: primer
  Description: Sanger sequencing of base edit of lacZ of E. coli
tgagcgcatttttacgcgc

SEQ ID NO: 529 - DNA, 18 bp, Artificial Sequence
  Description of Artificial Sequence: Synthetic primer
  Category: primer
  Description: Sanger sequencing of base edit of lacZ of E. coli
gaaaacggcaacccgtgg

SEQ ID NO: 530 - DNA, 20 bp, Artificial Sequence
  Description of Artificial Sequence: Synthetic primer
  Category: primer
  Description: Sanger sequencing of base edit of lacZ of E. coli
ggattgaaaatggtctgctg

SEQ ID NO: 531 - DNA, 18 bp, Artificial Sequence
  Description of Artificial Sequence: Synthetic primer
  Category: primer
  Description: Sanger sequencing of base edit of lacZ of E. coli
actgctgacgccgctgcg

SEQ ID NO: 532 - DNA, 48 bp, Artificial Sequence
  Description of Artificial Sequence: Synthetic primer
  Category: primer
  Description: Forward primer used to amplify CAT (H193Y) of CAT (H193Y)-sgRNA- MG68-4 variant-nSpCas9 (D10A)
ccgccgccgcaaggaatggtttaattaatttgatcggcacgtaagagg

SEQ ID NO: 533 - DNA, 50 bp, Artificial Sequence
  Description of Artificial Sequence: Synthetic primer
  Category: primer
  Description: Reverse primer used to amplify CAT (H193Y) of CAT (H193Y)-sgRNA-MG68-4 variant-nSpCas9
ggactgttgggcgccatctccttgcatgcttcacttattcaggcgtagca

SEQ ID NO: 534 - DNA, 50 bp, Artificial Sequence
  Description of Artificial Sequence: Synthetic primer
  Category: primer
  Description: Forward primer used to amplify CAT (H193Y) of CAT (H193Y)-sgRNA-MG68-4 variant-nMG34-1 (D10A)
aaggaatggtttaattaattctagattaattaatttgatcggcacgtaag

SEQ ID NO: 535 - DNA, 50 bp, Artificial Sequence; identical to SEQ ID NO: 533
  Description of Artificial Sequence: Synthetic primer
  Category: primer
  Description: Sanger sequencing primer of CAT (H193Y)

SEQ ID NO: 536 - DNA, 18 bp, Artificial Sequence
  Description of Artificial Sequence: Synthetic primer
  Category: primer
  Description: Forward primer used to amplify BE3 target site in HEK293T cells and Sanger sequencing
gaggctggagaggcccgt

SEQ ID NO: 537 - DNA, 22 bp, Artificial Sequence
  Description of Artificial Sequence: Synthetic primer
  Category: primer
  Description: Reverse primer used to amplify BE3 target site in HEK293T cells for Sanger sequencing
gattttcatgcaggtgctgaaa

SEQ ID NO: 538 - DNA, 36 bp, Artificial Sequence
  Description of Artificial Sequence: Synthetic primer
  Category: primer
  Description: Forward primer used to amplify A0A2K5RDN7-nSpCas9 (D10A)-MG69-1_site 1 in HEK293T cells
  modified_base (14)..(18): a, c, t, g, unknown or other
gctcttccgatctnnnnnaggaggaagggcctgagt

SEQ ID NO: 539 - DNA, 36 bp, Artificial Sequence
  Description of Artificial Sequence: Synthetic primer
  Category: primer
  Description: Reverse primer used to amplify A0A2K5RDN7-nSpCas9 (D10A)-MG69-1_site 1 in HEK293T cells
  modified_base (14)..(18): a, c, t, g, unknown or other
gctcttccgatctnnnnntctgccctcgtgggtttg

SEQ ID NO: 540 - DNA, 36 bp, Artificial Sequence
  Description of Artificial Sequence: Synthetic primer
  Category: primer
  Description: Forward primer used to amplify A0A2K5RDN7-nSpCas9 (D10A)-MG69-1_site 2 in HEK293T cells
  modified_base (14)..(18): a, c, t, g, unknown or other
gctcttccgatctnnnnnctctggccactccctggc

SEQ ID NO: 541 - DNA, 36 bp, Artificial Sequence
  Description of Artificial Sequence: Synthetic primer
  Category: primer
  Description: Reverse primer used to amplify A0A2K5RDN7-nSpCas9 (D10A)-MG69-1_site 2 in HEK293T cells
  modified_base (14)..(18): a, c, t, g, unknown or other
gctcttccgatctnnnnnggcaggctctccgaggag

SEQ ID NO: 542 - DNA, 44 bp, Artificial Sequence
  Description of Artificial Sequence: Synthetic primer
  Category: primer
  Description: Forward primer used to amplify A0A2K5RDN7-nSpCas9 (D10A)-MG69-1_site 3 in HEK293T cells
  modified_base (14)..(18): a, c, t, g, unknown or other
gctcttccgatctnnnnngggaataataaaagtctctctcttaa

SEQ ID NO: 543 - DNA, 36 bp, Artificial Sequence
  Description of Artificial Sequence: Synthetic primer
  Category: primer
  Description: Reverse primer used to amplify A0A2K5RDN7-nSpCas9 (D10A)-MG69-1_site 3 in HEK293T cells
  modified_base (14)..(18): a, c, t, g, unknown or other
gctcttccgatctnnnnnccccctccaccagtaccc

SEQ ID NO: 544 - DNA, 36 bp, Artificial Sequence
  Description of Artificial Sequence: Synthetic primer
  Category: primer
  Description: Forward primer used to amplify A0A2K5RDN7-nSpCas9 (D10A)-MG69-1_site 4 in HEK293T cells
  modified_base (14)..(18): a, c, t, g, unknown or other
gctcttccgatctnnnnncctgtccttggagaaccg

SEQ ID NO: 545 - DNA, 37 bp, Artificial Sequence
  Description of Artificial Sequence: Synthetic primer
  Category: primer
  Description: Reverse primer used to amplify A0A2K5RDN7-nSpCas9 (D10A)-MG69-1_site 4 in HEK293T cells
  modified_base (14)..(18): a, c, t, g, unknown or other
gctcttccgatctnnnnngcaggtgaacacaagagct

SEQ ID NO: 546 - DNA, 37 bp, Artificial Sequence
  Description of Artificial Sequence: Synthetic primer
  Category: primer
  Description: Forward primer used to amplify A0A2K5RDN7-nSpCas9 (D10A)-MG69-1_site 5 in HEK293T cells
  modified_base (14)..(18): a, c, t, g, unknown or other
gctcttccgatctnnnnngaaggtgtggttccagaac

SEQ ID NO: 547 - DNA, 36 bp, Artificial Sequence
  Description of Artificial Sequence: Synthetic primer
  Category: primer
  Description: Reverse primer used to amplify A0A2K5RDN7-nSpCas9 (D10A)-MG69-1_site 5 in HEK293T cells
  modified_base (14)..(18): a, c, t, g, unknown or other
gctcttccgatctnnnnntcgatgtcctccccattg

SEQ ID NO: 548 - DNA, 38 bp, Artificial Sequence
  Description of Artificial Sequence: Synthetic primer
  Category: primer
  Description: Forward primer used to amplify A0A2K5RDN7-nMG1-4 (D9A)-MG69-1_site 1 in HEK293T cells
  modified_base (14)..(18): a, c, t, g, unknown or other
gctcttccgatctnnnnnaaacaggctagacataggga

SEQ ID NO: 549 - DNA, 37 bp, Artificial Sequence
  Description of Artificial Sequence: Synthetic primer
  Category: primer
  Description: Reverse primer used to amplify A0A2K5RDN7-nMG1-4 (D9A)-MG69-1_site 1 in HEK293T cells
  modified_base (14)..(18): a, c, t, g, unknown or other
gctcttccgatctnnnnngaagccaccagagtctcta

SEQ ID NO: 550 - DNA, 36 bp, Artificial Sequence
  Description of Artificial Sequence: Synthetic primer
  Category: primer
  Description: Forward primer used to amplify A0A2K5RDN7-nMG1-4 (D9A)-MG69-1_site 2 in HEK293T cells
  modified_base (14)..(18): a, c, t, g, unknown or other
gctcttccgatctnnnnngccgccattgacagaggg

SEQ ID NO: 551 - DNA, 41 bp, Artificial Sequence
  Description of Artificial Sequence: Synthetic primer
  Category: primer
  Description: Reverse primer used to amplify A0A2K5RDN7-nMG1-4 (D9A)-MG69-1_site 2 in HEK293T cells
  modified_base (14)..(18): a, c, t, g, unknown or other
gctcttccgatctnnnnngcatcaaaacaaaagggagattg

SEQ ID NO: 552 - DNA, 36 bp, Artificial Sequence
  Description of Artificial Sequence: Synthetic primer
  Category: primer
  Description: Forward primer used to amplify A0A2K5RDN7-nMG1-4 (D9A)-MG69-1_site 3 in HEK293T cells
  modified_base (14)..(18): a, c, t, g, unknown or other
gctcttccgatctnnnnncctctgcccacctcactt

SEQ ID NO: 553 - DNA, 37 bp, Artificial Sequence
  Description of Artificial Sequence: Synthetic primer
  Category: primer
  Description: Reverse primer used to amplify A0A2K5RDN7-nMG1-4 (D9A)-MG69-1_site 3 in HEK293T cells
  modified_base (14)..(18): a, c, t, g, unknown or other
gctcttccgatctnnnnngccatgtgggttaatctgg

SEQ ID NO: 554 - DNA, 36 bp, Artificial Sequence
  Description of Artificial Sequence: Synthetic primer
  Category: primer
  Description: Forward primer used to amplify A0A2K5RDN7-nMG1-4 (D9A)-MG69-1_site 4 in HEK293T cells
  modified_base (14)..(18): a, c, t, g, unknown or other
gctcttccgatctnnnnnccggacgcacctacccat

SEQ ID NO: 555 - DNA, 37 bp, Artificial Sequence
  Description of Artificial Sequence: Synthetic primer
  Category: primer
  Description: Reverse primer used to amplify A0A2K5RDN7-nMG1-4 (D9A)-MG69-1_site 4 in HEK293T cells
  modified_base (14)..(18): a, c, t, g, unknown or other
gctcttccgatctnnnnnctagatgggaatggatggg

SEQ ID NO: 556 - DNA, 36 bp, Artificial Sequence
  Description of Artificial Sequence: Synthetic primer
  Category: primer
  Description: Forward primer used to amplify A0A2K5RDN7-nMG3-6 (D13A)-MG69-1_site 1 in HEK293T cells
  modified_base (14)..(18): a, c, t, g, unknown or other
gctcttccgatctnnnnnaaccacaaacccacgagg

SEQ ID NO: 557 - DNA, 36 bp, Artificial Sequence
  Description of Artificial Sequence: Synthetic primer
  Category: primer
  Description: Reverse primer used to amplify A0A2K5RDN7-nMG3-6 (D13A)-MG69-1_site 1 in HEK293T cells
  modified_base (14)..(18): a, c, t, g, unknown or other
gctcttccgatctnnnnntcaatggcggccccgggc

SEQ ID NO: 558 - DNA, 36 bp, Artificial Sequence
  Description of Artificial Sequence: Synthetic primer
  Category: primer
  Description: Forward primer used to amplify A0A2K5RDN7-nMG3-6 (D13A)-MG69-1_site 2 in HEK293T cells
  modified_base (14)..(18): a, c, t, g, unknown or other
gctcttccgatctnnnnnagtgatccccagtgtccc

SEQ ID NO: 559 - DNA, 36 bp, Artificial Sequence
  Description of Artificial Sequence: Synthetic primer
  Category: primer
  Description: Reverse primer used to amplify A0A2K5RDN7-nMG3-6 (D13A)-MG69-1_site 2 in HEK293T cells
  modified_base (14)..(18): a, c, t, g, unknown or other
gctcttccgatctnnnnngccctgaacgcgtttgct

SEQ ID NO: 560 - DNA, 42 bp, Artificial Sequence
  Description of Artificial Sequence: Synthetic primer
  Category: primer
  Description: Forward primer used to amplify A0A2K5RDN7-nMG3-6 (D13A)-MG69-1_site 3 in HEK293T cells
  modified_base (14)..(18): a, c, t, g, unknown or other
gctcttccgatctnnnnntgggaataataaaagtctctctct

SEQ ID NO: 561 - DNA, 36 bp, Artificial Sequence
  Description of Artificial Sequence: Synthetic primer
  Category: primer
  Description: Reverse primer used to amplify A0A2K5RDN7-nMG3-6 (D13A)-MG69-1_site 3 in HEK293T cells
  modified_base (14)..(18): a, c, t, g, unknown or other
gctcttccgatctnnnnncccctccaccagtacccc

SEQ ID NO: 562 - DNA, 36 bp, Artificial Sequence
  Description of Artificial Sequence: Synthetic primer
  Category: primer
  Description: Forward primer used to amplify A0A2K5RDN7-nMG3-6 (D13A)-MG69-1_site 4 in HEK293T cells
  modified_base (14)..(18): a, c, t, g, unknown or other
gctcttccgatctnnnnncagggcctcctcagccca

SEQ ID NO: 563 - DNA, 38 bp, Artificial Sequence
  Description of Artificial Sequence: Synthetic primer
  Category: primer
  Description: Reverse primer used to amplify A0A2K5RDN7-nMG3-6 (D13A)-MG69-1_site 4 in HEK293T cells
  modified_base (14)..(18): a, c, t, g, unknown or other
gctcttccgatctnnnnngtctggatgtcgtaagggaa

SEQ ID NO: 564 - DNA, 40 bp, Artificial Sequence
  Description of Artificial Sequence: Synthetic primer
  Category: primer
  Description: Forward primer used to amplify A0A2K5RDN7-nMG3-6 (D13A)-MG69-1_site 5 in HEK293T cells
  modified_base (14)..(18): a, c, t, g, unknown or other
gctcttccgatctnnnnnggggtgtaactcagaatgtttt

SEQ ID NO: 565 - DNA, 36 bp, Artificial Sequence
  Description of Artificial Sequence: Synthetic primer
  Category: primer
  Description: Reverse primer used to amplify A0A2K5RDN7-nMG3-6 (D13A)-MG69-1_site 5 in HEK293T cells
  modified_base (14)..(18): a, c, t, g, unknown or other
gctcttccgatctnnnnngggagtgagactcagaga

SEQ ID NO: 566 - DNA, 39 bp, Artificial Sequence
  Description of Artificial Sequence: Synthetic primer
  Category: primer
  Description: Forward primer used to amplify A0A2K5RDN7-nMG3-6 (D13A)-MG69-1_site 6 in HEK293T cells
  modified_base (14)..(18): a, c, t, g, unknown or other
gctcttccgatctnnnnngcaaagagggaaatgagatca

SEQ ID NO: 567 - DNA, 41 bp, Artificial Sequence
  Description of Artificial Sequence: Synthetic primer
  Category: primer
  Description: Reverse primer used to amplify A0A2K5RDN7-nMG3-6 (D13A)-MG69-1_site 6 in HEK293T cells
  modified_base (14)..(18): a, c, t, g, unknown or other
gctcttccgatctnnnnngtgacacatttgtttgagaatca

SEQ ID NO: 568 - DNA, 36 bp, Artificial Sequence
  Description of Artificial Sequence: Synthetic primer
  Category: primer
  Description: Forward primer used to amplify A0A2K5RDN7-nMG3-6 (D13A)-MG69-1_site 7 in HEK293T cells
  modified_base (14)..(18): a, c, t, g, unknown or other
gctcttccgatctnnnnnctttatccccgcacagag

SEQ ID NO: 569 - DNA, 36 bp, Artificial Sequence
  Description of Artificial Sequence: Synthetic primer
  Category: primer
  Description: Reverse primer used to amplify A0A2K5RDN7-nMG3-6 (D13A)-MG69-1_site 7 in HEK293T cells
  modified_base (14)..(18): a, c, t, g, unknown or other
gctcttccgatctnnnnncttggcccatgggaaatc

SEQ ID NO: 570 - DNA, 36 bp, Artificial Sequence
  Description of Artificial Sequence: Synthetic primer
  Category: primer
  Description: Forward primer used to amplify A0A2K5RDN7-nMG4-2 (D28A)-MG69-1_site 1 in HEK293T cells
  modified_base (14)..(18): a, c, t, g, unknown or other
gctcttccgatctnnnnngtcccatcccaacacccc

SEQ ID NO: 571 - DNA, 36 bp, Artificial Sequence
  Description of Artificial Sequence: Synthetic primer
  Category: primer
  Description: Reverse primer used to amplify A0A2K5RDN7-nMG4-2 (D28A)-MG69-1_site 1 in HEK293T cells
  modified_base (14)..(18): a, c, t, g, unknown or other
gctcttccgatctnnnnntgggcatgtgtgctccca

SEQ ID NO: 572 - DNA, 42 bp, Artificial Sequence
  Description of Artificial Sequence: Synthetic primer
  Category: primer
  Description: Forward primer used to amplify A0A2K5RDN7-nMG4-2 (D28A)-MG69-1_site 2 in HEK293T cells
  modified_base (14)..(18): a, c, t, g, unknown or other
gctcttccgatctnnnnnctatgggaataataaaagtctctc

SEQ ID NO: 573 - DNA, 36 bp, Artificial Sequence
  Description of Artificial Sequence: Synthetic primer
  Category: primer
  Description: Reverse primer used to amplify A0A2K5RDN7-nMG4-2 (D28A)-MG69-1_site 2 in HEK293T cells
  modified_base (14)..(18): a, c, t, g, unknown or other
gctcttccgatctnnnnnctccaccagtaccccacc

SEQ ID NO: 574 - DNA, 36 bp, Artificial Sequence
  Description of Artificial Sequence: Synthetic primer
  Category: primer
  Description: Forward primer used to amplify A0A2K5RDN7-nMG4-2 (D28A)-MG69-1_site 3 in HEK293T cells
  modified_base (14)..(18): a, c, t, g, unknown or other
gctcttccgatctnnnnnggaccctggtctctacct

SEQ ID NO: 575 - DNA, 37 bp, Artificial Sequence
  Description of Artificial Sequence: Synthetic primer
  Category: primer
  Description: Reverse primer used to amplify A0A2K5RDN7-nMG4-2 (D28A)-MG69-1_site 3 in HEK293T cells
  modified_base (14)..(18): a, c, t, g, unknown or other
gctcttccgatctnnnnncctctcccattgaactacc

SEQ ID NO: 576 - DNA, 36 bp, Artificial Sequence
  Description of Artificial Sequence: Synthetic primer
  Category: primer
  Description: Forward primer used to amplify A0A2K5RDN7-nMG4-2 (D28A)-MG69-1_site 4 in HEK293T cells
  modified_base (14)..(18): a, c, t, g, unknown or other
gctcttccgatctnnnnnccccagtgactcagggcc

SEQ ID NO: 577 - DNA, 40 bp, Artificial Sequence
  Description of Artificial Sequence: Synthetic primer
  Category: primer
  Description: Reverse primer used to amplify A0A2K5RDN7-nMG4-2 (D28A)-MG69-1_site 4 in HEK293T cells
  modified_base (14)..(18): a, c, t, g, unknown or other
gctcttccgatctnnnnntcgtaagggaaagacttaggaa

SEQ ID NO: 578 - DNA, 42 bp, Artificial Sequence
  Description of Artificial Sequence: Synthetic primer
  Category: primer
  Description: Forward primer used to amplify A0A2K5RDN7-nMG18-1 (D12A)-MG69-1_site 1 in HEK293T cells
  modified_base (14)..(18): a, c, t, g, unknown or other
gctcttccgatctnnnnntctcccttttgttttgatgcattt

SEQ ID NO: 579 - DNA, 36 bp, Artificial Sequence
  Description of Artificial Sequence: Synthetic primer
  Category: primer
  Description: Reverse primer used to amplify A0A2K5RDN7-nMG18-1 (D12A)-MG69-1_site 1 in HEK293T cells
  modified_base (14)..(18): a, c, t, g, unknown or other
gctcttccgatctnnnnnccaccccaggctctgggg

SEQ ID NO: 580 - DNA, 44 bp, Artificial Sequence
  Description of Artificial Sequence: Synthetic primer
  Category: primer
  Description: Forward primer used to amplify A0A2K5RDN7-nMG18-1 (D12A)-MG69-1_site 2 in HEK293T cells
  modified_base (14)..(18): a, c, t, g, unknown or other
gctcttccgatctnnnnnccttttgttttgatgcatttctgttt

SEQ ID NO: 581 - DNA, 36 bp, Artificial Sequence
  Description of Artificial Sequence: Synthetic primer
  Category: primer
  Description: Reverse primer used to amplify A0A2K5RDN7-nMG18-1 (D12A)-MG69-1_site 2 in HEK293T cells
  modified_base (14)..(18): a, c, t, g, unknown or other
gctcttccgatctnnnnnaatctaccaccccaggct

SEQ ID NO: 582 - DNA, 36 bp, Artificial Sequence
  Description of Artificial Sequence: Synthetic primer
  Category: primer
  Description: Forward primer used to amplify A0A2K5RDN7-nMG18-1 (D12A)-MG69-1_site 3 in HEK293T cells
  modified_base (14)..(18): a, c, t, g, unknown or other
gctcttccgatctnnnnnatccccagtgtccccctt

SEQ ID NO: 583 - DNA, 36 bp, Artificial Sequence
  Description of Artificial Sequence: Synthetic primer
  Category: primer
  Description: Reverse primer used to amplify A0A2K5RDN7-nMG18-1 (D12A)-MG69-1_site 3 in HEK293T cells
  modified_base (14)..(18): a, c, t, g, unknown or other
gctcttccgatctnnnnnccaggccctgaacgcgtt

SEQ ID NO: 584 - DNA, 36 bp, Artificial Sequence
  Description of Artificial Sequence: Synthetic primer
  Category: primer
  Description: Forward primer used to amplify A0A2K5RDN7-nMG18-1 (D12A)-MG69-1_site 4 in HEK293T cells
  modified_base (14)..(18): a, c, t, g, unknown or other
gctcttccgatctnnnnnaggccaggcctgcggggg

SEQ ID NO: 585 - DNA, 41 bp, Artificial Sequence
  Description of Artificial Sequence: Synthetic primer
  Category: primer
  Description: Reverse primer used to amplify A0A2K5RDN7-nMG18-1 (D12A)-MG69-1_site 4 in HEK293T cells
  modified_base (14)..(18): a, c, t, g, unknown or other
gctcttccgatctnnnnnccaaaaactcccaaattagcaaa

SEQ ID NO: 586 - protein, 969 aa, Artificial Sequence
  Description of Artificial Sequence: Synthetic polypeptide
  Category: adenine base editor
  Description: TadA (ABE8.17m)-nMG34-1 (D10A)
MGSSHHHHHHSEVEFSHEYWMRHALTLAKRARDEREVPVGAVLVLNNRVIGEGWNRAIGLHDPTAHAEIMALRQGGLVMQNYRLIDATLYSTFEPCVMCAGAMIHSRIGRVVFGVRNAKTGAAGSLMDVLHYPGMNHRVEITEGILADECAALLCYFFRMPRRVFNAQKKAQSSTDSGGSSGGSSGSETPGTSESATPESSGGSSGGSMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEGSGGSPKKKRKV

SEQ ID NO: 587 - protein, 1104 aa, Artificial Sequence
  Description of Artificial Sequence: Synthetic polypeptide
  Category: cytosine base editor
  Description: rAPOBEC1-nMG34-1 (D10A)-UGI (PBS1)
MGSSHHHHHHMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESAMERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAELEGSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 588 - protein, 1592 aa, Artificial Sequence
  Description of Artificial Sequence: Synthetic polypeptide
  Category: adenine base editor
  Description: MG68-3-nSpCas9 (D10A)
MGSSHHHHHHMNEQTSTDEQFMQQALALADEAERQGEVPVGALLVHQGTVIGRGFNQVITQLDPSAHAEMLAIRDAARYLQNYRILDTTLYVTLEPCPMCAGALVHARVKRLVYGASDPRTGACGSVFNVVADTRLNHQLEVVAGVLGSQCGERLSAFFRQRRAAQKALKKAAQNFQSPSSGGSSGGSSGSETPGTSESATPESSGGSSGGSMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSGGSPKKKRKV

SEQ ID NO: 589 - protein, 1588 aa, Artificial Sequence
  Description of Artificial Sequence: Synthetic polypeptide
  Category: adenine base editor
  Description: MG68-8-nSpCas9 (D10A)
MGSSHHHHHHMPQSEQDIYWIRYAMQLAERAEQAGEVPVGAVLVLDNQALGEGWNLSISRHDPCAHAEIMAIRQAGERIGNYRLLGATLYVTLEPCVMCAGAMVHSRIARVVYGASDLKTGAAGSVFDVLSDPRHNHVVEITGGVESEACSQQLSDFFRRRRAEQKAEKQRLKDNQSGGSSGGSSGSETPGTSESATPESSGGSSGGSMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSGGSPKKKRKV

SEQ ID NO: 590 - protein, 16 aa, Artificial Sequence
  Description of Artificial Sequence: Synthetic peptide
  Category: Linker
SGSETPGTSESATPES

SEQ ID NO: 591 - protein, 17 aa, Artificial Sequence
  Description of Artificial Sequence: Synthetic peptide
  Category: Linker
SGSETPGTSESATPESA

SEQ ID NO: 592 - protein, 32 aa, Artificial Sequence
  Description of Artificial Sequence: Synthetic peptide
  Category: Linker
SGGSSGGSSGSETPGTSESATPESSGGSSGGS

SEQ ID NO: 593 - protein, 34 aa, Artificial Sequence
  Description of Artificial Sequence: Synthetic peptide
  Category: Linker
GTSGGSSGGSSGSETPGTSESATPESSGGSSGGS

SEQ ID NO: 594 - protein, 206 aa, Cebus imitator
  Description: CMP/dCMP-type deaminase domain-containing protein (uniprot accession A0A2K5RDN7)
MEASPASRPRPLMGPRTFTENFTNNPEVFGRHQTYLCYEVKCQGPDGTRDLMTEQRDFLCNQARNLLSGFDGRHAERCFLDRVPSWRLDPAQTYRVTCFISWSPCFSCAREVAEFLQENPHVNLRIFAARIYDCRPRYEEGLQMLQNAGAQVSIMTSEEFRHCWDTFVDHQGHPFQPWEGLDEHSQALSRRLQAILQGNRWMILSL

SEQ ID NO: 595 - protein, 167 aa, Unknown
  Description of Unknown: Adenosine deaminase sequence
  Description: TadA* (ABE8.17m)
MSEVEFSHEYWMRHALTLAKRARDEREVPVGAVLVLNNRVIGEGWNRAIGLHDPTAHAEIMALRQGGLVMQNYRLIDATLYSTFEPCVMCAGAMIHSRIGRVVFGVRNAKTGAAGSLMDVLHYPGMNHRVEITEGILADECAALLCYFFRMPRRVFNAQKKAQSSTD

SEQ ID NO: 596 - protein, 747 aa, Unknown
  Description of Unknown: uncultivated organism sequence
  Description: MG34-1 effector
MERELVLGIDYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAE

SEQ ID NO: 597 - protein, 747 aa, Unknown
  Description of Unknown: uncultivated organism sequence
  Description: MG34-1 (D10A)
MERELVLGIAYGGKYTGLAVVDRRHNQVLYANRLKMRDDVAGILKDRRKQRGIRRTAQTKKKRLRELKNYLKSIGYNESTATFETVYSLAHKRGYDYADMPEEKTSEEIEAMDVEERKQWEKEKQEWEETKRNSRHRKEVVKDVHKAMIEGRATEEQIKRVERIFNKQYRPKRFNNRILTKCKVEDCGVNTPLRKNVRDLLIENIVRFFPIEQSEKDNLKDAVLDKNRREEVKSFFRKHKTDEHIRKQVYDIADNKLSGRTVFCKEHILEHTEHSKEERKVFRLAPSLKTKIENVLAVIKDEILPKFTVNKVVMESNNFDIAAKTQGKKRLAKEEYGKGPREGKETRKEALLRETDGRCIYCGKSIDISNAHDDHIFPRKAGGLNIFANLVACCAVCNENKKGRTPLESGISPKPEIIAFMKNDLKKKILEDARNINTVDFNKYMSHASIGWRYMRDRLRESAGNKKLPIERQSGIYTAYFRRWWGFKKERGNTLHHALDAVILASRKGYSDDGLVDMTLKPKYNKGGEFDPEKHLPEPIEFKMDKGSRGSALHDRNPLSYKKGIITRRFMVTEIECGKEDDVISETYREKLKEAFKRFDTKKGKCLTDKEAKEAGFCIKKNELVMSLKCSIKGTGPGQMIRINNNVFKTNVHNVGVDVYLDEKGKKKAYERKNPRLSKHFIEPPPQPNGRVSFTLKRRDMVTVEGEDAIYRIKKLGTSPTIEAVVGSDGKTRTVSATKLTKANSAE

SEQ ID NO: 598 - DNA, 3 bp, Unknown
  Description of Unknown: PAM sequence
  Description: MG34-1 PAM
  modified_base (1)..(1): a, c, t, g, unknown or other
ngg

SEQ ID NO: 599 - protein, 16 aa, Artificial Sequence
  Description of Artificial Sequence: Synthetic peptide
SGSETPGTSESATPES

SEQ ID NO: 600 - protein, 5 aa, Artificial Sequence
  Description of Artificial Sequence: Synthetic peptide
SGGSS

SEQ ID NO: 601 - protein, 25 aa, Staphylococcus aureus
MKRNYILGLDIGITSVGYGIIDYET

SEQ ID NO: 602 - protein, 24 aa, Artificial Sequence
  Description of Artificial Sequence: Synthetic peptide
MKKKVFAFDLGKASIGYCVRDGFN

SEQ ID NO: 603 - protein, 28 aa, Artificial Sequence
  Description of Artificial Sequence: Synthetic peptide
MEKEKNNHVWGFDIGKGSLGEAVRVGGD

SEQ ID NO: 604 - protein, 28 aa, Artificial Sequence
  Description of Artificial Sequence: Synthetic peptide
MSTDMKNYRIGVDVGDRSVGLAAIEFDD

SEQ ID NO: 605 - protein, 27 aa, Artificial Sequence
  Description of Artificial Sequence: Synthetic peptide
MSEHTKYRIGIDVGDRSVGLAAIEFDD

SEQ ID NO: 606 - protein, 28 aa, Artificial Sequence
  Description of Artificial Sequence: Synthetic peptide
MSTDMKNYRIGVDVGDRSVGLAAIEFDD

SEQ ID NO: 607 - protein, 32 aa, Artificial Sequence
  Description of Artificial Sequence: Synthetic polypeptide
MGDQQTLQATSYCLGLDVGVQGVGWAVIDLDD

SEQ ID NO: 608 - protein, 25 aa, Artificial Sequence
  Description of Artificial Sequence: Synthetic peptide
MSNKTILGLDLGVSSIGWAIIERND

SEQ ID NO: 609 - protein, 38 aa, Artificial Sequence
  Description of Artificial Sequence: Synthetic polypeptide
MEITINREIGKLGLPRHLVLGMDPGIASCGFALIDTAN

SEQ ID NO: 610 - protein, 23 aa, Artificial Sequence
  Description of Artificial Sequence: Synthetic peptide
MNYVLGLDVGIASVGWAVLELNE

SEQ ID NO: 611 - protein, 24 aa, Artificial Sequence
  Description of Artificial Sequence: Synthetic peptide
MIKNILGLDLGVGSIGWALIQTED

SEQ ID NO: 612 - protein, 27 aa, Artificial Sequence
  Description of Artificial Sequence: Synthetic peptide
MDQSKEYYIGLDGGTDSVGWAVLNPDY

SEQ ID NO: 613 - DNA, 22 bp, Artificial Sequence
  Description of Artificial Sequence: Synthetic oligonucleotide
cgtttgccgtctgaatttgacc

SEQ ID NO: 614 - DNA, 22 bp, Artificial Sequence
  Description of Artificial Sequence: Synthetic oligonucleotide
gaagatcaggatatgtggcgga

SEQ ID NO: 615 - DNA, 22 bp, Artificial Sequence
  Description of Artificial Sequence: Synthetic oligonucleotide
acgggtaacagtttctttatgg

SEQ ID NO: 616 - DNA, 22 bp, Artificial Sequence
  Description of Artificial Sequence: Synthetic oligonucleotide
cgttgctgcataaaccgactac

SEQ ID NO: 617 - DNA, 22 bp, Artificial Sequence
  Description of Artificial Sequence: Synthetic oligonucleotide
aaaacccgaaactgtggagcgc

SEQ ID NO: 618 - DNA, 22 bp, Artificial Sequence
  Description of Artificial Sequence: Synthetic oligonucleotide
gattgaaaatggtctgctgctg

SEQ ID NO: 619 - DNA, 22 bp, Artificial Sequence
  Description of Artificial Sequence: Synthetic oligonucleotide
tacgggtaacagtttctttatg

SEQ ID NO: 620 - DNA, 22 bp, Artificial Sequence
  Description of Artificial Sequence: Synthetic oligonucleotide
gcgttggcaatttaaccgccag

SEQ ID NO: 621 - DNA, 22 bp, Artificial Sequence
  Description of Artificial Sequence: Synthetic oligonucleotide
ctgaatatcgacggtttccata

SEQ ID NO: 622 - DNA, 22 bp, Artificial Sequence
  Description of Artificial Sequence: Synthetic oligonucleotide
cacatttaatgttgatgaaagc

SEQ ID NO: 623 - DNA, 22 bp, Artificial Sequence
  Description of Artificial Sequence: Synthetic oligonucleotide
acacaaatcagcgatttccatg

SEQ ID NO: 624 - DNA, 22 bp, Artificial Sequence
  Description of Artificial Sequence: Synthetic oligonucleotide
atggatgagcagacgatggtgc

SEQ ID NO: 625 - DNA, 22 bp, Artificial Sequence
  Description of Artificial Sequence: Synthetic oligonucleotide
ttcatctgtggtgcaacgggcg

SEQ ID NO: 626 - DNA, 22 bp, Artificial Sequence
  Description of Artificial Sequence: Synthetic oligonucleotide
acgagcatcatcctctgcatgg

SEQ ID NO: 627 - DNA, 22 bp, Artificial Sequence
  Description of Artificial Sequence: Synthetic oligonucleotide
cgacccgcattgaccctaacgc

SEQ ID NO: 628 - DNA, 22 bp, Artificial Sequence
  Description of Artificial Sequence: Synthetic oligonucleotide
cacaaatcagcgatttccatgt

SEQ ID NO: 629 - DNA, 22 bp, Artificial Sequence
  Description of Artificial Sequence: Synthetic oligonucleotide
tgatgaagcagaacaactttaa

SEQ ID NO: 630 - DNA, 22 bp, Artificial Sequence
  Description of Artificial Sequence: Synthetic oligonucleotide
aatattgaaacccacggcatgg

SEQ ID NO: 631 - DNA, 22 bp, Artificial Sequence
  Description of Artificial Sequence: Synthetic oligonucleotide
aacgtcgaaaacccgaaactgt

SEQ ID NO: 632 - DNA, 22 bp, Artificial Sequence
  Description of Artificial Sequence: Synthetic oligonucleotide
aaacccacggcatggtgccaat

SEQ ID NO: 633 - DNA, 22 bp, Artificial Sequence
  Description of Artificial Sequence: Synthetic oligonucleotide
tcaaaaaatggctttcgctacc

SEQ ID NO: 634 - DNA, 22 bp, Artificial Sequence
  Description of Artificial Sequence: Synthetic oligonucleotide
aagcagcgttgttgcagtgcac

SEQ ID NO: 635 - DNA, 22 bp, Artificial Sequence
  Description of Artificial Sequence: Synthetic oligonucleotide
tcagccggaaaacctaccggat

SEQ ID NO: 636 - DNA, 22 bp, Artificial Sequence
  Description of Artificial Sequence: Synthetic oligonucleotide
gccagctggcgtaatagcgaag

SEQ ID NO: 637 - DNA, 22 bp, Artificial Sequence
  Description of Artificial Sequence: Synthetic oligonucleotide
agggtgaaacgcaggtcgccag

SEQ ID NO: 638 - DNA, 22 bp, Artificial Sequence
  Description of Artificial Sequence: Synthetic oligonucleotide
ctacgtctgaacgtcgaaaacc

SEQ ID NO: 639 - DNA, 22 bp, Artificial Sequence
  Description of Artificial Sequence: Synthetic oligonucleotide
ggcaactctggctcacagtacg

SEQ ID NO: 640 - DNA, 22 bp, Artificial Sequence
  Description of Artificial Sequence: Synthetic oligonucleotide
ccggaaaacctaccggattgat

SEQ ID NO: 641 - DNA, 20 bp, Artificial Sequence
  Description of Artificial Sequence: Synthetic oligonucleotide
tttctttcacagatgtggat

SEQ ID NO: 642 - DNA, 20 bp, Artificial Sequence
  Description of Artificial Sequence: Synthetic oligonucleotide
caggatatgtggcggatgag

SEQ ID NO: 643 - DNA, 20 bp, Artificial Sequence
  Description of Artificial Sequence: Synthetic oligonucleotide
tgcgaatacgcccacgcgat

SEQ ID NO: 644 - DNA, 22 bp, Artificial Sequence
  Description of Artificial Sequence: Synthetic oligonucleotide
cggcgtttcatctgtggtgcaa

SEQ ID NO: 645 - DNA, 22 bp, Artificial Sequence
  Description of Artificial Sequence: Synthetic oligonucleotide
gccaggacagtcgtttgccgtc

SEQ ID NO: 646 - DNA, 22 bp, Artificial Sequence
  Description of Artificial Sequence: Synthetic oligonucleotide
tcagccgcgctgtactggaggc

SEQ ID NO: 647 - DNA, 22 bp, Artificial Sequence
  Description of Artificial Sequence: Synthetic oligonucleotide
cccttcccaacagttgcgcagc

SEQ ID NO: 648 - DNA, 22 bp, Artificial Sequence
  Description of Artificial Sequence: Synthetic oligonucleotide
ctgtcgtcgtcccctcaaactg

SEQ ID NO: 649 - DNA, 22 bp, Artificial Sequence
  Description of Artificial Sequence: Synthetic oligonucleotide
gtgacggcagttatctggaaga

SEQ ID NO: 650 - DNA, 22 bp, Artificial Sequence
  Description of Artificial Sequence: Synthetic oligonucleotide
atgatttcagccgcgctgtact

SEQ ID NO: 651 - DNA, 22 bp, Artificial Sequence
  Description of Artificial Sequence: Synthetic oligonucleotide
ttactgccgcctgttttgaccg

SEQ ID NO: 652 - DNA, 22 bp, Artificial Sequence
  Description of Artificial Sequence: Synthetic oligonucleotide
cgaatggcgctttgcctggttt

SEQ ID NO: 653 - DNA, 22 bp, Artificial Sequence
  Description of Artificial Sequence: Synthetic oligonucleotide
tcccctcaaactggcagatgca

SEQ ID NO: 654 - DNA, 22 bp, Artificial Sequence
  Description of Artificial Sequence: Synthetic oligonucleotide
atctacaccaacgtgacctatc

SEQ ID NO: 655 - DNA, 22 bp, Artificial Sequence
  Description of Artificial Sequence: Synthetic oligonucleotide
caacgggcgctgggtcggttac

SEQ ID NO: 656 - DNA, 22 bp, Artificial Sequence
  Description of Artificial Sequence: Synthetic oligonucleotide
aaggcggcggagccgacaccac

SEQ ID NO: 657 - DNA, 22 bp, Artificial Sequence
  Description of Artificial Sequence: Synthetic oligonucleotide
gccgatcgcgtcacactacgtc

SEQ ID NO: 658 - DNA, 22 bp, Artificial Sequence
  Description of Artificial Sequence: Synthetic oligonucleotide
gatccgcgctggctaccggcga

SEQ ID NO: 659 - DNA, 22 bp, Artificial Sequence
  Description of Artificial Sequence: Synthetic oligonucleotide
ccttcccgcccggtgcagtatg

SEQ ID NO: 660 - DNA, 22 bp, Artificial Sequence
  Description of Artificial Sequence: Synthetic oligonucleotide
cggtcaatccgccgtttgttcc

SEQ ID NO: 661 - DNA, 22 bp, Artificial Sequence
  Description of Artificial Sequence: Synthetic oligonucleotide
tcctttgcgaatacgcccacgc

SEQ ID NO: 662 - DNA, 22 bp, Artificial Sequence
  Description of Artificial Sequence: Synthetic oligonucleotide
ggtcggcttacggcggtgattt

SEQ ID NO: 663 - DNA, 22 bp, Artificial Sequence
  Description of Artificial Sequence: Synthetic oligonucleotide
acgtgacctatcccattacggt

SEQ ID NO: 664 - DNA, 22 bp, Artificial Sequence
  Description of Artificial Sequence: Synthetic oligonucleotide
atccgccgtttgttcccacgga

SEQ ID NO: 665 - DNA, 22 bp, Artificial Sequence
  Description of Artificial Sequence: Synthetic oligonucleotide
cgacggcacgctgattgaagca

SEQ ID NO: 666 - DNA, 22 bp, Artificial Sequence
  Description of Artificial Sequence: Synthetic oligonucleotide
gaccagcccttcccggctgtgc

SEQ ID NO: 667 - DNA, 22 bp, Artificial Sequence
  Description of Artificial Sequence: Synthetic oligonucleotide
tccgtttatccgggcaaaccat

SEQ ID NO: 668 - DNA, 20 bp, Artificial Sequence
  Description of Artificial Sequence: Synthetic oligonucleotide
cctctggatgtcgctccaca

SEQ ID NO: 669 - DNA, 20 bp, Artificial Sequence
  Description of Artificial Sequence: Synthetic oligonucleotide
gggacgcgcgaattgaatta

SEQ ID NO: 670 - DNA, 20 bp, Artificial Sequence
  Description of Artificial Sequence: Synthetic oligonucleotide
cgttttacaacgtcgtgact

SEQ ID NO: 671 - DNA, 20 bp, Artificial Sequence
  Description of Artificial Sequence: Synthetic oligonucleotide
ggactctggccactccctgg

SEQ ID NO: 672 - DNA, 20 bp, Artificial Sequence
  Description of Artificial Sequence: Synthetic oligonucleotide
cgtattgagaggtgggaatc

SEQ ID NO: 673 - DNA, 20 bp, Artificial Sequence
  Description of Artificial Sequence: Synthetic oligonucleotide
gtgtcccccttccctatggg

SEQ ID NO: 674 - DNA, 20 bp, Artificial Sequence
  Description of Artificial Sequence: Synthetic oligonucleotide
tccagctccagccccagagc

SEQ ID NO: 675 - DNA, 20 bp, Artificial Sequence
  Description of Artificial Sequence: Synthetic oligonucleotide
ggagagcctgcctgcctggg

SEQ ID NO: 676 - DNA, 20 bp, Artificial Sequence
  Description of Artificial Sequence: Synthetic oligonucleotide
cccttccctatgggaataat

SEQ ID NO: 677 - DNA, 20 bp, Artificial Sequence
  Description of Artificial Sequence: Synthetic oligonucleotide
ttccggctctgagggccagt

SEQ ID NO: 678 - DNA, 20 bp, Artificial Sequence
  Description of Artificial Sequence: Synthetic oligonucleotide
ccccctctccctccatcagt

SEQ ID NO: 679 - DNA, 20 bp, Artificial Sequence
  Description of Artificial Sequence: Synthetic oligonucleotide
gctccagccccagagcctgg

SEQ ID NO: 680 - DNA, 20 bp, Artificial Sequence
  Description of Artificial Sequence: Synthetic oligonucleotide
ccttctgtttgtcccacttg

SEQ ID NO: 681 - DNA, 20 bp, Artificial Sequence
  Description of Artificial Sequence: Synthetic oligonucleotide
tacacagtttcccaagctac

SEQ ID NO: 682 - DNA, 20 bp, Artificial Sequence
  Description of Artificial Sequence: Synthetic oligonucleotide
gcctctccctgcagacggta

SEQ ID NO: 683 - DNA, 20 bp, Artificial Sequence
  Description of Artificial Sequence: Synthetic oligonucleotide
tctaggcctggcttggccaa

SEQ ID NO: 684 - DNA, 20 bp, Artificial Sequence
  Description of Artificial Sequence: Synthetic oligonucleotide
cctgccgtgtaccagctgag

SEQ ID NO: 685 - DNA, 20 bp, Artificial Sequence
  Description of Artificial Sequence: Synthetic oligonucleotide
gcctatgggaactctggagg

SEQ ID NO: 686 - DNA, 20 bp, Artificial Sequence
  Description of Artificial Sequence: Synthetic oligonucleotide
ttgccacgaagcaggccaat

SEQ ID NO: 687 - DNA, 20 bp, Artificial Sequence
  Description of Artificial Sequence: Synthetic oligonucleotide
ggcccagactgagcacgtga

SEQ ID NO: 688 - DNA, 20 bp, Artificial Sequence
  Description of Artificial Sequence: Synthetic oligonucleotide
cccggggccgccattgacag

SEQ ID NO: 689 - DNA, 20 bp, Artificial Sequence
  Description of Artificial Sequence: Synthetic oligonucleotide
tccggctctgagggccagtg

SEQ ID NO: 690 - DNA, 20 bp, Artificial Sequence
  Description of Artificial Sequence: Synthetic oligonucleotide
caaccagtccccagtgactc

SEQ ID NO: 691 - DNA, 20 bp, Artificial Sequence
  Description of Artificial Sequence: Synthetic oligonucleotide
gagtccgagcagaagaagaa

SEQ ID NO: 692 - protein, 6 aa, Artificial Sequence
  Description of Artificial Sequence: Synthetic peptide
HHHHHH

SEQ ID NO: 693 - DNA, 21 bp, Artificial Sequence
  Description of Artificial Sequence: Synthetic oligonucleotide
ctggcgattcaggttcattat

SEQ ID NO: 694 - DNA, 21 bp, Escherichia coli
ctggcgattcaggttcatcat

What is claimed is:

1. An engineered nucleic acid editing system comprising:
   (a) an endonuclease comprising a RuvC domain and an HNH domain, wherein the endonuclease is a class 2, type II Cas endonuclease, wherein the endonuclease comprises the amino acid sequence of any one of SEQ ID NO: 597 or 70-78;
   (b) a base editor coupled to the endonuclease, wherein the base editor comprises an amino acid sequence having at least 95% sequence identity to the amino acid sequence of SEQ ID NO: 386, wherein the base editor is an adenosine deaminase; and
   (c) an engineered guide ribonucleic acid structure configured to form a complex with the endonuclease, wherein the engineered guide ribonucleic acid structure comprises:
      (i) a guide portion configured such that the guide portion hybridizes to a target deoxyribonucleic acid; and
      (ii) a non-guide portion configured such that the non-guide portion binds the endonuclease.

2. The engineered nucleic acid editing system of claim 1, wherein the endonuclease is configured to bind to the target deoxyribonucleic acid, wherein the target deoxyribonucleic acid comprises a protospacer adjacent motif (PAM) sequence comprising SEQ ID NO: 598.

3. The engineered nucleic acid editing system of claim 1, wherein the engineered guide ribonucleic acid structure comprises a sequence having at least 80% sequence identity to any one of SEQ ID NO: 88-96 or 488-489.

4. The engineered nucleic acid editing system of claim 3, wherein the engineered guide ribonucleic acid structure comprises a sequence having at least 80% sequence identity to SEQ ID NO: 489.

5. The engineered nucleic acid editing system of claim 1, wherein the guide portion and the non-guide portion are in a single ribonucleic acid.

6. The engineered nucleic acid editing system of claim 1, wherein a region of the guide portion is complementary to a eukaryotic, fungal, plant, mammalian, or human genomic target.

7. The engineered nucleic acid editing system of claim 1, wherein the guide portion is 15-24 nucleotides in length.

8. The engineered nucleic acid editing system of claim 1, wherein the endonuclease or the base editor further comprises one or more nuclear localization sequences (NLSs).

9. The engineered nucleic acid editing system of claim 1, wherein the endonuclease is covalently coupled directly to the base editor or covalently coupled to the base editor through a linker.

10. The engineered nucleic acid editing system of claim 9, wherein the endonuclease is covalently coupled directly to the base editor.

11. The engineered nucleic acid editing system of claim 1, wherein the endonuclease comprises the amino acid sequence of SEQ ID NO: 597.

12. The engineered nucleic acid editing system of claim 1, wherein the base editor comprises the amino acid sequence SEQ ID NO: 386.

13. The engineered nucleic acid editing system of claim 12, wherein the endonuclease comprises the amino acid sequence of any one of SEQ ID NO: 70-78.

14. The engineered nucleic acid editing system of claim 11, wherein the base editor comprises the amino acid sequence of SEQ ID NO: 386.

15. The engineered nucleic acid editing system of claim 9, wherein the endonuclease covalently coupled to the base editor comprises the amino acid sequence of SEQ ID NO: 476.

\* \* \* \* \*